United States Patent 10,407,724 (METHODS AND COMPOSITIONS FOR SCREENING AND TREATING DEVELOPMENTAL DISORDERS) - sequence listing, part 80

SEQ ID NO: 2247 - DNA, 116120 bp, Homo sapiens
  misc_feature (45418)..(95417): n is a, c, g, or t
tcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgtgaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatgtattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacggatatatgtttactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatgcgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttcttttatttatttatttatttatttatttatttattgttatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaaaagtccccagggtgtgatattccccttcctctgtccatgtgatctcattgttcagttcccacctatgagtgagaatatgcggtgtttggttttttgttcttgcgatagtttactgagaatgatgatttccactttcatccatgtccctgcaaaggacatgaactcatcattttttagggctgcatagtattccatggtgtatatgtgccacattttcttaatccactctatcgttgttggacatttgggttggttccaagtctttgctatcgtgaataatgccgcaataaacatacgtgtgcatgtgtctttatagcagcatgatttatagtcctttggttatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcattgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatcttatgaaggaaacattgattctggaggatttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaacacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttaatagctttcgcttcatcggtttcacatctcttccctccgtctcttaccgtgctgcccacacactcacacacacacacacacacacacatacggatatatgtttacttttattaatggtgaattgtctcgataaagtttcagggattatggtcctttaccctatgtacttgagggtgtgtatatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttcctttgtttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcacaggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacagactttatctagagtgagtcattccattctgttccaaatttgctgagagtattcatttgaatatatgttgattttcatcaaacagtgcatctatttcgattaccacagcgttttttcccattcatgggttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgttcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggatagttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcacccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttacggtgctgcccacacactcacacacacacactcacacacacatacggatatatgtttactgttattaatgttgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatactgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagggcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcaacctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagactcacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagtgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttgtaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatcacccatagggttctgtttttagtccatttaataaaacccaaagtgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2248 - DNA, 18251 bp, Homo sapiens
tgccgtcggtgccgccgccgccgccgatatggcgcgtacggcccctgtggagcccccgctgcggcattccgcgcccccctcgccggccgcgggtgagccccgcacctcggtcgaggcggcggtggccccgcggagggtgctgttcgccgacgaggccttggggctgccgctggcgcagttgcgccgctaccggccgtggggcgggcccggggcgggcaagatggcggcggcggccgggcaagatggcggcggcggcggcggggccgacgaggacgacgatggcgaggatggggatgaaggggaggaggaagaggaggcttgccccgagccctcaccgctgtgccccgtccccgctggcggggggttttacctggtccccacattttcgctgccgcccgcgccgggccgtctggagcgcttggggcgcgtcatggtggagctggaggcgctgctgccgcctcccggagcggtccccgggggtgccggggtgtgggtgcctgggggccgcccgccggtgctgcgcgggttggtacgcgtgctgaaccgctccttcgagaaggcggtgcacgtgcgggcctcacacgacggctgggcttccttttgcgaccacccagcgcgctacgtcccgcgcagcccgccgtgggcaggagcgggaggaacaggagcaggagatcccatcctggatccggggctcggcctgggtcccggccaggcatccgcctcctcgcccgacgacggcggccgcaccgaccgctttgccttccagctgccctttgctgagggcgcgggcgatggggcgcgcctcgacttcgtggtgcgctatgagacccctgagggcactttctgggccaacaaccacggccgcaactacacagtcctgctccggatcgcacccgctcccacacccactgatgccgaagggctgccccagcagcagcagctgccgcagctggagccacagcccgagtgccagggtcccgtggaggctgaggccaggcagctgaagagctgcatgaagccggtgaggcgcaggtaatgtcagccagcgccacctccgccaacgcagggctgtgtctgggatggaggacaagcattccggcccaggaacccctcaggcctgctctccaggacagggaggagggtgcattgagtcagtcagtcaaagagtgatggaggtcaaacacgtgctaggcactgttttaactggggttttattcctccatttattgagttccactgtaaagccctgaacaagacagacatctaccctaccctcaaggattcatacaggctcctatgggagacagtttgaaaaaacaagcaagcaagcagataggataaatagggacaaagttagctgctgaagggagtaaggggatagattgggagggaatgactgtgtcagacatgctgttaaagggagggcctttgaggaggtgagtcccgaatgatgataaagaagagttatgcagatacggtggggaggtgggggagagtttgtaggaaaaggaacagggaggacttttctgaggaggtttcatttaaactaagtcctggatgatgaataacagttatgtgcatatatggaacaagggtgttctaggtagaggaaacagcaagtgcaaagtcctggggtggaaatgagcttggtgtgaatgatcagcagtgtgctggagtggagagaactgcaatgacatagtgtggaccaagggctttgccagtggggggtagagcagattctctttctgacagagcaggaaaccaggattccagaggtggagaaactggttgaggcagtgatggcacctggctcttccagttcacccatgcctgaccttgaagcctgtgcactctactgttaacgctgtaatctacttttgagtcctgtggaggcgaggggctgagcccatgctctcacaagaaagcagtggctctagcagagagacagaaccagatgggtactggacttgaagtttttgtcccttgtttttttgccacaccacctgtgatcatttagggacagggagaaataatcagttataccccagggggccccagaagatttccctaggtttcctctatcaagctatgagttctttaagggcagcagctagtcctgattctttttgcggtcacctaagtctggcccaggatcactagattctccctaaaatgtatacatttccctgttcctgggaggactgggaatggaaatgggaaaatgctttttggaccttgtatgtatacgcttggtcagaagcccctggctgcagtaagacatttgtgggttctgctggttctggtaaggccttaggctgtgagtggttcagaaaggtctagctccggtctggtgggcagatgtgcctgggtaactgagcaggcaggcaggtacccactcacccacctgtgagccccaccataatctgagacttcatttaaagggggcaggcagcatggtttttcttacagcattaagagtgtggattctggcatagattgcctgggttcaaatcctggcgctgccacttactggccttgtgaccttggccaacgcatttaactacaccatgcctcaggaccctcacctgtaaaacagaattatagcatctactttacgggataagagtaaaggtgctcagaaccgagtctggctcaaagtagtatcatacaggtgttagctagtgtcagtatttagggagccacacctacagtttcctggattcctctcctaaattcggctccgcccatcagctgtgtggccttgcctccgtttccttctctgctaagggaaatgacagtcactttgcatggttggattgaatgcagcaaacatgggcaaggtaactgaagcatggtggtaactgcaaaagataactggccagcatttactgatttctgtgctatgaacatcagatccattctctccgtgaggcctgctgtgcatgctgtgttgtgtaggtgctatgattatccccatttagtagaggggagacaggtagctcagagagatgagccagcttgctcaaagcctctcagctagtgagtgacagggccagggaagaaatgctagggacatttatttttttctatttttttttttttaaactggtcctctagaaagcgtggcatgattcagggcaaattctggatttcactcttggtgttcccagcatgtcgtgctttccttttacctttttttttttttttgctttatcgaggtatacctacataaagtgtactgatattctgtgtatagcccagtggatttgtacatatgtatgcacttgtgtagccaccacccagatgaagatactgagcaggtccagtaccccagagctaccttcatttctatcactttcccaagctgtcatccccgccggctgtcatgggaaccctgtctgtaagatgcgacagtttgggtaaaggagtttggtcattttaaagagtgtgaaaggcagagaacagagaaatcaaaaccttgcagggccaaggtgggtggagagggtgtttttcttttaacatacatgggcggttttaaggagaaattgaagcagcctgttcagacaattgttttggtatctggccccaggtctgtggttcctaacatgacttgtgatattattttaagtgggcagatggctttttgatagcttctttatctttcgatctcagctcttgcaaaggggaggttggtgctcattgcaagatcagcgataagggtttctttgtaggtcggtggctttcttggtgagtacatttcaacatattattgttttagaacctgtgtgctgccagtgacttgcagcactgttgaagactagccaccctttgtgacctagccctcttgggaaatggcggaggatctcagggtatatcccttacctgtgggagccctatcagagggcttcctgttgaggaaatgttggctgtaggccctctgtgcactgagcacagccacatcaggtgagggcatgggagaagtccgtggtagccatcaggatagagttcagaaacccaaatggctgctttccctgggttgctggaccaggcatttggtaactctaaagcttagagatgattcatcgacaagcatttattgactgcctactgtgtgctgggcacagtgctaggttccagcagggaaagagatgcagagtggtcctaagatgtcacagggcttgtgggatggagtacagaggatttgttgtatgagacctggctgagcccctgctcttcgccaggcacttcactgagtactatattttcatgcaaggtctggtttaattccgacaacattccctgtgaagtagagggttttaaatttctctttcctggatgagcaaactgaggctcccagagtccaaagtcctagggctggtgtggggaaaagccctcctgatcttccttggcacttgacactaccctttggaagtgtcctattcttcttaaaagtaaagaccaagagagcctcaccatggtcttcaagcaccctcccatcccattccccaatctggcctccactggctcatagtcttaacaccagtggtctttctgagctcctgtcaccatggtctttctgttactccaaagggcctcgctcctttctgctgcagggcctttgcccctgctgtttccttcaccaggaacatttatcccgtaccccttgcagtctcctccagtgttgatccctcagttctaagaggacttccccaggggagcctgtccaccccagtgtcctcgggcccctggctttttcatagcactcatcagcccagcacgtgctaagctttgttagagaatgtcccatggcagagcagatgaacatcgccaccagtcgaggggtcatcggccaccctgcctagcagttctactatatttttttgatccactcgtttctcctctgaagtgactctttcaaatgttctttaccttcagactttctctcctgcttcaaaaaacaaaacagaagccataagaatggaactccctataacttgtggcccccaagtctgcacgctgatttccctcccctgtgttacagatgacgaggagtcccttcttgctcaggccacttctccctcctgtgctctgggtcccagtttctgctacttgctctagaatctgacatcatcagtcaccttttctctcctggcaggttttctgctgccctccttgcttgatcctctattcacctttgcctgtgccagcatcccttctgtctccgctgaccccacgttctctccctcctgcttctggccagcacctcatcaccctccccttcactgctgacccctgcagagttgcctgtacttgccttctgcacttgctcacccccgtaagtgttagcccccggcatctgccagattctgcaggtggttttttagttttcctcttgaagtggttgaccactcctacttaaaacactttgtcttcccttgccttgagaccacactctgctggttttcctcttaactctctggcccttctctttctcctggctcttcccttagcttcatgtatccaaactcggcatctccacttgactgatggcccaaataattcctcaaactcaccttgtcggggactgcattcatcacctctcccacagtgttcccaagcagcctctcactcccctacctccccacttgctcgttttgcttttcagcatccttaagtaagccctgcctgaccctgtagattgggccagggacccttattctagggcattctttccttttctaaaggcactgatcgcagtttgtagttatatctttattagggggttgctggatgactctctgccccgctagactgtaagctccgtgaggggtagggacatggtctgctttcattcaccactgtattcctgcaggcctgccacagtgcctggcacttagcaggtgctcaataaatgtttgttgaaataatgagtttgagtatttttttaatgtcttcctccatactgaattgtaagcttcctagttgggtttgctcaccatggtgtctccaggatccgtcactggggctgatgcacaggaaggcccactgtctttcagtgcacctataactgaagggatggggatccaacctgctatctgagttggcagcctcaggggaaaccagaataactggagttgaacgggacaagtcaggggcatcttagttttctgtagagtgaggaattaatgtgaacgtgatcctcttttatgccacagaaaacttggtagggcattatggttaaggacatgggcctgaggccacgtgctaagaaagtggcagagctgggatctgagcctgtgtggtcctgctctagtgctccagctcttagctactgtaccaggctgggtgatgcattttaccagcagggcaacactgggcaagttgctttcctttcagagcttcagtttccctcaatggaaatttggagggggttactgttaagtgctttataggtacttttcaaatatttctttgatctgctgaacaactcactgatgtaggtattattatcccctccttagagatgaggtaactgaggcacagagaggttaagtaacttgccccaggtcacacagctgataggtggcagagctggaattgttcaaaattgcatatcctaaccctttattgagttgtgaaatcaatttactgggtttcaacaagcattaaaaagaaaaaggaaatagcataagaaatgccagtgtatcaccacatgcagtaaaggtaagtattgtttcactcgaagaacaaccatttttcagttatttatatgtctgtttacacgtgtgggtgtgctgggttatgatgtagaatggatttcttactatgggtcgtggccaaagaatgaagtcatggctgttgaagaagctcatggcacgagaaactgctctccctctaccccactggatcacccgcaagtcccagagttgaggctgacacacttgttggggaaggcaaagcagtgccccacataacttggtggctttcacagccaccttcaaaccctgttcttttcagaaagcagatggctcagggtaactgcaattctgagtatcgtggggcaggtttctgaagccactcatccccccggaaagtcagcgttatcttcaggttgactacatgggagccggggtctgctgagtttccctttgggtttcagtgcctgacccactttgggctggcaaaattctttgaaaacatgaatgctgggggtgctccagaggactcgggtggtggtggcaatggcagtctgtgactgctctgaaagtctgctttgcttttctccacagggcttgtcagccctcacccgctcgcttactctgtgactggcgaatcacctttcttggctttcttggctggcctaggccggggccaacaccacctctttccaaatcctcaccctctggtctcctcggggcctatcagcttggcagccattgtgtttcctgatggccggaggaatttgcacgcccaggagactggcgtgcaggcctgagatggccccttttagtcgacaccagcttgactagtgctcactagcacccaaatgatgcatgtccaagattttccagatctgtgtgccctggcccctatggctcactgcccttgaggggatgccacgtggtacttgtggggctggtgccaaaagaacaggtttccttcttgaaaacgagcaggcatactgcaggtacagttttgttcttaatcttctccctccccatttttctaagaacccctcttctctgttaccgatcagtgagtcagtatacatttgtacttgatttctcttactatcctcatgttgattgaagtcatagctgcccttgagtttttactgtgaaagacggttcaaagataacttgtttctttttaagcccacaatttcaaactctcttcaaagtggagccctcctggagtgtttgttaccagcgtggttgtgtagtcagtgagtgtagagatgcagttccttgagttttagtttttgcatttgtaaaaaggaagggtgttgttttgaaggatagatgtgaaggttttcaaatgccttggtgtgtcaatgagaggggcccatggtggaggaggtgaacaatacatgcttgtgctttctgctttcatatctgactttggagaacgacttgtttgcttctgtcgatgttgtggatcttgggattggctcaatggcgtgacctgctttttggatgttctcgccctcctcagccatggaaagggtgctctgggggctgaaggattgattgtgtatttgtttttctttctccttcctccaactgaattgtggagtcctttacctgctggctagctgattcctgagtgttctcctttttctgtctcacatctatgactgcagtggcttttagaagcctgtttgtaatatatgtccggactaggccagatggaggagaaggcttgcctgctactgcgcacaggtgggagggctggctttctgtctgtctgtgggccttcttgaagaggcttggtttagaagatcctaggaggaggatgttttctgtcatgaaggactatggtaacaaaaagaagtaagttagtgcagcctggcagaaattgtgttgaaacaaaagtccaaagacctggattttaggaccacggaggggattggtgtgagaccaagctggtttgctctgaatctctctttctcatctgtgatgtgtgggaggtggcagctgggctcccagagtcacccaccctaggccctgtagtattctgattcaagtacctctggtgggatttgtgagtcctagacagtagagaaagacagacggtcccttctagactctagatccgtatatatggttcaaatgttctccccgagggtgtttatagaaagcagttcttgcagccattctgtgtctagtggcctcctagccacgcatgtcccaggcccatggaggtagggaaatggggaatgaatatgtgggcaaaggcaggtccaaagaaaagcctgcatgaaggaggagggagggatcttgtctagtattgatgcctccctctatctacttctagaaaggatggagatgggttgggtaagaccccagtctccctcatccaagaagcagcagctgactgggtaagagccaaaaggcctgggttgtgatgtgaagtgtatgaccttgagccatttactcagcctctgttttatcctctgtaaaatggagacaatagtactgcctgcttcagaggattacaagtacctgtctcatagggtgattgtgaggattgaattaacacatgttgcccaggcaccgtggctcatgcctgtagtactaggacttcgggaggctgagatgggaggatcgcttgagtccaggagttcacgaccagcctggtcaacgtaggaagaccccatctctaaaaacaaaatacaaaaaaacaaaaacaaaaaccaaaaaaccccaaaaacttctttaaaaaaatgtgaagcacttagaacagtgtgtaatgccatagtaggtactatgtatgggtcagatggtgatactcgtttctgtgaaggtaattggttatgggttttcaaaaagtttcaaccaggccgggcacggtggctcatgcctgtaaccccagcacattgggaggccgaggagggtggatcacctgaggtcaggagtttgagaccagcctggccaacatggcgaaaccccgtctctattaaaaatacaaaaattagctggctgtgatggtgggtacctgtaatccctgatacttgagaggctgaggcaggagaatcacttgaacctgggaggcagaggttgcagtgagccgagatcatgctattgcactccagcctggcgacagaacgagactccatctcaaaaaaaaaaatttttcaaccattgtcagaagtatcaagaatgtcacattgcctcttaggaagaaaaaggtgtgggcattcgccccagctcctctcaggttttagtcaatgcttccctcatttaccttaatctgtagacacttgatactcattttcagaataagaacagtgacttctccatgatgagatgccacccctgggaggacccacctgaaatgcactcggcttatgccactcagggatctgactggcctggtgaaggaggagcaagacccataaatatctacagttgattcaatcccagctgtgtgtcaggccctgatttctggctgtccatcctcattcctcttgactgccctgtgcttagtgcacatcctgactccccggggctctgttttatgagtgaggaggtgaagcgacctgccaggctgatacggggacgagagggttagcatagggacccaggcctctgtgacctccctcccagtctccatttgcattccttcctctgcctcacagtcttgtctacctgccatttcttagaaaaggtgtttttgttttgttttgttttgttttgtttttgtgagataatctctcactctgtcgcccaggctggagtgcagtggtgtgatttcggctcactgcaatctctacctcttgggttcaagcgattttcctgcctcagcctcccaggtagttgggattacaggcgcccaccaccacgcccagctaatttttatatttttagtagagacggagtttcaccatgttggccaggctggtcttgaattcctgacctcaggtgatccacctgcctcggcctcccaaactgttgggattacagatgtgagccaccgcgtctggccctttttttttttttgagactgagtttcactcttgtcccctaggctggagtgcaatggcgcgatcttggctcactgcaacctccgcctcccaggttcaaatgattctcctgcctcggcctcccaagtagttgggactatgggcgtgcaccgccatgcccagctaattttttgtatttttagtagagacagggtttcatcatgttgcccaggctggtcttgaactcctaacctcaagtggtctccctgcctcggcctcccaaagtgctggaattacaggtgtaagccaccacgcccagccgaaaagatgggttcttctatcttttctctttccatagccaggaatgtatcctaaagaaatgatacaagtgtcgataaaactatgcccaatgctgtttgctggtttgctttgcaacctctaaatgaaagaacttagctgctcagtaggaagggaatggtatgatatgagtattaagcagccatttgaaatgtttgcaaaagtgtataatgatgtttcttactgttaaatggacaaagctagctgtgaaattatgtctgtagaatctaaatgatttcgtagaatatctggaaggaaattttccagaatggtaacagtagttgtctctggctgatgtgtgattgtttttcttgcttctttagactttcctgtattttgcgaattttctataatgaggctgtaggacttttaggatgaggggataaacaaaggcagcagaagagaaaacagcagctgtcaggtgaaggtgggctagcacagaggctcagaaggtgccagtgggtggcagaagtgacctctcagggtattattagatccatgtactctctcctctgccctgcaggcctgccgaggaggaactgaagacgaagaacatggatgataacacctttgccatgggtaagcaattggcaagcttcggaagttttagcttgtatttaccatgtctttcttcctactgtttttctttctataaaaatgaaaaaggctgggctcagtggctcatgcctgtaatcccagcactttgggaggctgaggcaggaggattgcttgaggccaggagttcgagatgagcctgggcaacatagtgagacctcatctcttaaaaaaaaaaaaaaaagacgggcatgctggcatgcatccgtagtccctgctactcgggaggctgagctgggaggatcatttgagcctgggaggttgatgctgcagtgagtcatgattgtgccactgcaccccagccttggtgacacatcgagaccctatctcaaaaaaaaaatgaaggggtaccctctgctttagattgtcacagaaagcttcagaggcaaaactgccagttggctaggatggcagattttcttaacaaaaccatacctacttgtatgcctgtcttgcccaatgctgcctttctcttccctctagcagagcatcctgatgtccaggagtcagtgggtccactggtagcccccacccctctccgtccatggccccagatgacacttcaggtaagtgggtccttgcagccttggagtagacagcccaataggaggctcacagtgtgactattgctgggctgggtggtggggcccactagctctgggtcctccctgggttggagggagggcacaaaactcagaacctgatgggggagggggagaatgcagttactcagctgggcttgtagaaatgtcatttgttaatttagcaaaaatttatggagtgcttgttctgtgctaagcactgttacaaacatgcaaaaacgctctttgagggggcttatgtgttagtagggtgagacatgataaagtaatagaatatatggtactttaggtgatgatgagtgataaggaaaaatagaaaggaatagggagtgggtgagagactctgtgtgtgtgtgtgtgtgtgtgtgtgtgtgtgtgtgtgtgtgtgtgtgttgtgggcgggggtcggttgcaactttagattgggtggcctgggaaggctttagtgattagtgagatctgagcgaagatctgaggaaggtgagagagtgagccacgtggataactaagggaagaacatcccaggcgagtgtgaagttcctgaggtgaggccatgactaacgtgtgtgagggacagtgtagaagccagcgcagcaggggcagaacgagggagggggagagtggtgcggggtgagggagagaggtggctgaggacagattgggtggtgcctcacaggccatggtgaagactttggcttttactccgagtgagggggagccgcaagagcattgtggacggaggagggatgtaatctgatttaggatttaacaggctccctctggctgctgcttggaaaatagacgtcagagtaagggtggaaacaggcgactcgtgaaggggaggccactgcagtggtccaggcgagagtgatggtaggtaggggaggtagagacattttggagggtgtgtgtgtgtgtgtgtgtgtgtgtgtgaactttttaattacaaaaagtttcaaacatacaaaagtaaaatagtataatgaacctacgtacaccatcccccagcttcagtaaatatcaacacgtgctcattcttattttatctgtaccccgtctcctccctcccattccctctggaattattttggaagacatccagacatcatcccatccataaatacttctgtttgtatctcagaaaattaagaactcttttttgtttttttttttgagacagagtctcactctgtcacctaggctggagtgcagtggtgtgatctcagcttactgcaacctctgcctcctgggttcaagcaagtacatccagctaatttttgtatttttagtagagacgggatccgttgccttggcctcccaaagtgctgggattacaggtgtgagccatcacgtctggccagaaaattaagaattcttaaccccacaatactatcatcacaccttagaaaataaacggtaattcctcagtatcatcaagtatttggtcagtgttcaagttttcttctctcataagtgtttaggatccaaacaaagttgacatgttgcatttgattgatgtgtctctttagatttttaaaatctcccccactttgtttctttgcaatttgttggttgaagaaactttgcttgtcctgtagaattttccagtctgggtctggctgattacatccaggtggaaatacatttcttactccatttttattaatttattaattatattaattaatgtaatcttattaaatttatttaatttatcaaattgtattaaacgaatgtatttaatcttttattattaaattaactagaattaactctatttaattctattattcccacttcctttattagctagaattcttctctaaagaaaaactgtcccacaccagctatttggctactttgagatatagtttgtgcagaaaaagcagtgtaaatatttaattttttccattttatttaccagttttcagagaagtactactacaaaggtgaccaataaaaggatttttggttttgtgtcattatgaactcatgaattctaaacatatttgaatgagtttcaatccattgcacttatttgtttgctttttttgatgcttaaattgaactatccctggctagtaggagcttattgagatgggctactctgtccttttgacacgccctcatcattctgtgagcctttctcacatcttccatgacaatatgtgctaggttcatcctgtactctccctgccccaagcctggaaacagccatttctttcttgcttttcttttctttattttctttttctttttctttcttttctttcctttcctttctttccttacctttcctttctttctttcctttcctttgtctctctctttctttcttttcttttactttatttttctttcctttctttcctctctctctctctttctttcttttttctttttctttcttttttttttttttttttttgagtcagagtctttctctgtcgcccaggctggagtgcagtggcacaatctcggttcactgcaacctctgccttctgggttcaagcaattctcctgtctcagcctcttgagtagctgggattacaggcacatgccaccacacccggctgatttttgtatttttgcagagatggggtttcaccatgttggccaggctggtcttgaactcctgacctgcctggtgatccacctgccttggcctcccaaagtgctgggattacaggcgtgagccactgagcctggccagaaacagctatttctttaaggagcactgattcctttcagtggagagtggcattcaaaggccaagatttgggggctcggcatgcttgctgctactagattggtcattgtttctaggccctttcaaaagatggagctaggaaataattgttttttaaagagaagatgatacatcatgggttcatatggacatcctggctatgttttgggatttttttgcattttattttttttaaaatttttttaatttttaatttttgaggggacatagtaagtgtatatatttatggagatgttttgatataggcatgcattgtgtaataatcacatcatggagaatgaggtatgcatctcctcaagcatttatcctgtgtgttacaaacaatccacttacactctttattttttttttttttgagacaaagtctctgtcgcccaggctgcagtgcagtggcacagtctcggctcactgcaatctctgccctctgggttcaagtgattctcctgcctcagcctcttgagattacaggcgcacaacaccacgcccagctaatttttgtatttttggtagagacggggtttcaccatgttggccaggctggtctcgaactcctagtttcatgtgatccgcccgccttggcttcctaaagtgcttggattacaggtgagagccactgtgcctggctacttacacttttagttattttaactggctctgttttgaaggtaagccagcagtatttagtgatgatcattcaccaaatattcacacccaccgaattcctcagctttataatctgcaagaagccctgttttactgcatccaattgtgttattttaccatagatgacagtctttggagtctagacagtgacagagggcgctttaaggcatttttatatagaaacccctgtggggctggctgtgggctgtcacacttcttactgtctctgcttgttccatcccctcctctgcttcattcccttgctttttctctgcccccttgccccggccatggctccaggtttctgacgttccgatgactggcaaccccgcagaagaaggtgatgtccccagaagcagtccacctgtggcttttacagaggtcctccaggcaccggccatcaggattcccccctcctcccctctctgtggcctgggtggctcccccagagaccaggcctcagggcccgatgcgagcgagggggccaccgggcctttcctggagcccagtcagcagcaggcagaggccacatggggagtatcgagtgagaatggaggggggctggaggctgtgagtgggtcagaggagctgctcggtgaggacaccatcgaccaggagctggagcagctctacctgtctcacctgagccgcctacgggctgctgtggctgcgggtggggcagggggtggtggggagggctccacagatggagggatgtcccccagccatcccctgggcatactgacggaccgcgacctgatcttgaagtggcctggccctgagcgggccctgaacagcgccctggctgaggagatcacgctgcactatgcccggctggggcgtggcgtggagctcatcaaggacaccgaagaccctgatgatgaaggggagggtgaagaggggctctctgtcacaccctccagcccagaaggggacagccccaaggaatcgcctccagaaatcctctccggggcccgttctgtggtagccacgatgggagatgtgtggctcccatgggcagagggctcaggatgtgacggccctgtggttctgggtacagagggtcagttcattggggatcctgagaaagggatgggcaaggacaccagctctttgcacatgaatagggtgatagctggggtgactgagtccctgggggaggccgggacagaagcccagatagaggtcaccagtgagtgggcaggcagcttggatcccatatctggcaaggagccagcctctcccgtccttctgcaggggcaaaatcccaccctcctcagtcccttgggggccgaagtctgtctctctagtgtagccaggcctcatgtgagctcccaggatgaaaaggatgcaggcccaagccttgaacccccaaagaagtctcccaccctagcagtccctgcagaatgtgtgtgtgcactgcctcctcagctccgggggcccttgacccagactctgggggtcctggccgggctagtggtggtccctgtggctctgaacagcggtgtgtccctcctggtgcttgcgctgtgcctctctctggcttggttctcataggctctgcttgtgggatcagcagaggcttaagatgggatacatggcctgtgcagtgaggggacctgggtcctttgcttctgagaatgctcaactgaaagagaggccttctcatccccaagctctccagtcaacacagggctccctgtggtgacaccagtggagatgagggaacgggtagatggtgtgagtgaggggaacttttagagtggaactgggcatgtcctccgcctaccccccgagcctgtatttatttttgtataattctctggatgagggagagtggtcgtgagctggtcttggggcacaattacccagagatatatttattaacagccaacctgtgcaacctgctggagctttatttttaatttaatttatatagagtacctattattatatgccacaatagagctctatgagaaacagtgtcttgcggtgtagtgttctcctgtttgggcatgagtgtgcagggtggtcactttctgtgggaggatcacagtggggagttgggggtgggacgtggtcgcctgctgctgcttcaacatgtctttccttgaagatgtgtgtctcctcgtctcgtggtcctaatccatatggttctttgtcttttccacattctgcctgtgggaccctacaggtgtgtatttggatggtggtggtgggagccagggaggaagagtggcagccacatgagggtttggtgtcagtcacatggttgcagtggtagctgtggtctcctgtggatgtggggacatcagttgtgaatcagccacaaggttttgaggttactgaaaaaacagcctttgacaccagcagggagaccccttagtccctgagataaggaaggcctcagaaaggaaagaggagttaatgtactgcagtacttggtagcacagttgctgtccacagacatcacatttctactaaaaacaggaagcccagaagctttgaaagaaagatatatatttattgcatgcaaataaaaaactgctcaacaaaataa

SEQ ID NO: 2249 - DNA, 77931 bp, Homo sapiens
  misc_feature (26341)..(76340): n is a, c, g, or t
gctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcacccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttacggtgctgcccacacactcacacacacacactcacacacacatacggatatatgtttactgttattaatgttgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatactgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagggcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcaacctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2250 - DNA, 125598 bp, Homo sapiens
  misc_feature (54896)..(104895): n is a, c, g, or t
gctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctattatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacatactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatacgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatacttttagggtacatgtgcacgttgtgcaggttagttacatacgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctgcaaaggacatgaactcatcattttttagggctgcatagtattccatggtgtatatgtgtcacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcaattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgtgaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatgtattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacggatatatgtttactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatgcgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttcttttatttatttatttatttatttatttatttattgttatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaaaagtccccagggtgtgatattccccttcctctgtccatgtgatctcattgttcagttcccacctatgagtgagaatatgcggtgtttggttttttgttcttgcgatagtttactgagaatgatgatttccactttcatccatgtccctgcaaaggacatgaactcatcattttttagggctgcatagtattccatggtgtatatgtgccacattttcttaatccactctatcgttgttggacatttgggttggttccaagtctttgctatcgtgaataatgccgcaataaacatacgtgtgcatgtgtctttatagcagcatgatttatagtcctttggttatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttcttttttttttctttctttctttgttctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcattgccattgtaaagagttttatttccttttctgattttatggcattgcgcagacccacccgttacaatggtgacagtggacatccttgtcttatccctgatgagaaaccgaaaaatttcaacatttcaccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatcttatgaaggaaacattgattctggaggatttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaacacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttaatagctttcgcttcatcggtttcacatctcttccctccgtctcttaccgtgctgcccacacactcacacacacacacacacacacacatacggatatatgtttacttttattaatggtgaattgtctcgataaagtttcagggattatggtcctttaccctatgtacttgagggtgtgtatatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttcctttgtttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcacaggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacagactttatctagagtgagtcattccattctgttccaaatttgctgagagtattcatttgaatatatgttgattttcatcaaacagtgcatctatttcgattaccacagcgttttttcccattcatgggttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgttcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggatagttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcacccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttacggtgctgcccacacactcacacacacacactcacacacacatacggatatatgtttactgttattaatgttgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatactgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagggcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcaacctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagactcacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagtgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttgtaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatcacccatagggttctgtttttagtccatttaataaaacccaaagtgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttctttttttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgtgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatatttttttcttttcccttttgtatttttttgtagagacggggttttgccatgtttcccgggctgttgttgaacttttgagtgcaagtgatgcacccacctcacctcccacagtgctgggattactggcgtgggccaccgtggcgggcccgtcgttggcattgtaaagagttttatttccttttctgattttatggcattgtgcagacccacccgttacaatggtgacagtggacatccttgtcttctccctgatgagaaaccgaaaaatttcaacatttcgccatcctattcactctcctttttttgtagacggactttatcagagtgagtcattgcattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2251 - DNA, 77952 bp, Homo sapiens
  misc_feature (26352)..(76351): n is a, c, g, or t
aacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagcgctcctcccacctcagcctcctgagtagctgtgagtataggtacatgccaccatgcccagctaatttttcgatggtttttttgtttgttttttgtagtgatgagattttctgatgttgcttaggctggtctcgaagtcctgagctcaggtgatctggccagctcagcctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcacccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactggggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttacggtgctgcccacacactcacacacacacactcacacacacatacggatatatgtttactgttattaatgttgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatactgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaagtcttgcgcatcttttgtgaagtttatttctagctttttgatgctgtgaaatatgtatcattctttgaaatcgtgtattgtaactctctgagctggtatgtagagacatcgttctttttttttttctttctttctttgtcctcttttgagacggagtcttgctctgtcgcccaggctggagtgcagtggcgcgatctctgctcactgcaaccccgcctcccggattcaagcaattgtctgcctcagcctcccgagtagctgggattataggcacccaccagcacgcctggctaagttttgtgtttttactagagatgggctttcgccatcttggccggggtgctcttgaactcctgacctcgtgattcacctgccttggcctcccaaagtgctgggattacaggcatgagcctccgcgcccggtggagacataattcttacatattggttttctatccagcggccttgtgaaatatgcttgtgaattctaaagtttacttctaggtcgttttcagtcttcaatatacagaaacatatcatcctggaataagagcagttttgtttccgccatttttttttcttttcccttttgtatttttttgtagagacggggttttgccatgtttcccgggctgttgttgaacttttgagtgcaagtgatgcacccacgtcacctcccacagtgctgggattactggcgtgggccaccgtggcgggcccgtcgttgccattgtaaagagttttatttccttttctgattttatggcattgcgcagacccacccgttacaatggtgacagtggacatccttgtcttatccctgatgagaaaccgaaaaatttcaacatttcgccatcctattcactctcctttttttgtagacggactttatcagagtgagtcattccattctgttccaaatttgctgagagtattcatttgaatatatgttgattttcatcaaacagtgcatctatttcgattaccacagcgttttttcccattcatgtgttaatatagtgaattcgattgataaatttgtacgtttttaggttcgattattaaaacttgagacagcgtctcactctgtcaccgaggctggagtgcggtggtgttatcagagctcgctgcagccttgacctcctgggctcaagggcgcctcccacctcagcctcctgaggagctgtgagtataggtacatgccaccatgcccagctaatttttcgatggttttttgtttgttttttgtagtgatgagattttctgatgttgcttaggctggtctcgaagtcctgagctcaggtgatctggccagctcaacctcccaaaatactaggattacaggcgtgagccttggcctggtctggtttttcttatataggggtcttatctatataaagactaaagttaatctgtgcctttgtgcgggtgggctaagagcatgatgacttttatcattctattgatttaaagaaaactgtccttgacttaccagtgtgtaagtccatgaaagcataattctgttgaaagcatatattgttaatgggtgttgggaaccgtgcactttccgctgctgtgggagcatgtccttggaggtacctttcatctgttttctcaactccaaacatcttaggaccatgggttgtgactggtaggactatgtatcttgctgctttcaagacggagtatattttcacgtggtgtcactctggctgtcctgtttccctaatactgtcacttcaccctctgcgattctgatgctacaaatgatagatatcgttttagcattttcttacgggtcctagcgattctattcatttttctttcagtctctttctctgacttgttcacattgaacaatttccttttgggataggttgctatttctgttttcgcaggtggtttacctgtcttcccagccagtcacagtggtccttgtccccatggtgggtccggggcaagagagggccctgggttgggggtggggttcagttgaagatggggtgagttttgaggggagcactacttgagtcccagaggcataggaaacagcagagggaggtgggattcccttatcctcaatgaggatgggcatggagggtttggggcgtggcgctgggaacggcagccctccccagcccacagccgcgcatgctccctgggctcccgcctcagtgcgcatgttcactgggcgccttctgcccggccccttcgcccacgtgaagaacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgca

SEQ ID NO: 2252 - DNA, 18251 bp, Homo sapiens; identical to SEQ ID NO: 2248

SEQ ID NO: 2253 - DNA, 176669 bp, Homo sapiens
tgtcacatgagccgcgcgcccgcttcgctccccctcctccccggctgggctgtgtgaatgaagctctgccggctacgtggggcgctcactcaacttggtgtcctggacgccagagccgaccgagcgcgctgcccaccggcggcggacacgggctccgccgctccggacctcggcgacaggtaaaggcaaacgggctgtcccttccccaacagtccttggcgggccgctggcccccggcccacccccggagcaccccctaagcgcagcgacacaggggaagcgcaatcccgctggcttggacccccggagatggggcttccccgcgcccggcgttggcagcccggcgcttagaggaggtagacaggctagttccagccagtgctgagcggcgttttcccgggagcccagccctgttctccgagttatggtccctgggttgcccgagcgaagtttccttgcggagcggcgccaagcccgccccgcttttgaatcggagtgtttagccgcctgcgtcccctttcccggactggggtagggtgacttaggctggcaaagctcagccgaggcccggctcttctccctccggctctggacttgccgctggttttgtatgggtcttagcaaagtggagaaactctcggaaaagtagttgctgcgctgttttccttttgccacttaacgcgcgtagctggttctctccagactttcgagccttgctcttgagcgccttgatccacacgggaaaagctttgcctttacattgacgcacgtttcctttgattaacatttcagagcaaatcagttgcctggagttcccagtgaagttgtacctgtgcccgtgcgataacgtcagtggaagctgccccgagtaagtgagggaaatctagaagtttggagcataaaaaaccagcacgaatcaactttacataaacttcatacatttattagcaactgctcgggtttaacttcagggatgttaaatttcgcctagtcccacgggacgatgatcattacttcttaactgcacgcgaaataggagaagaaaaaaggcaaatcaaaacagactgtcccaggtctcagagaagtcatcggagcgctttttcctgctgaattcaccctaggagtttgtgagttcctagttttcttggacttcgcgaacttttccttgtccaaagcactgtcttttctctgttggtgttttgggactggtgtacacattaacccttttgtcattaaagaaggccaacacgattctcaagctagtattagccttcagtgtttgtgctttagcactttcacttaggaggtggaggtgttggttgtataaaagatatggaaataacaatctactttgatgttcaccaggtcaaaaaggtgaagacttttagaaaaaacagattggcttgtatgctaagtagggaagaccagtttattaactgagatcttgtttaaatgggcaagcagagtgttaagcctctaagtcaaactaagtcgtcagacctctcattttttctcccattcctagctcctattttttttttttttttttggtttgagccggctctcgttctgtcgcccaggctggagtgcagtggcacaatcttggctcactgcaacctccgcctccctcccgggttcaagcgattctcctgcctcagccttccgagtagctgggattacaggcgtcacttgtaattatagtgcaccgccatacctggctaatttttgtatttttagtagagacggggtttcaccatgttggccaggctggtctcgaactgacctcaggtgatccgcctgcttcggcctcccaaagtgctgggattacaccgcacccggcccctaactcctttaatatttttgcaaatattgtcctaggactggatttgaagttttaacaacaggaattagctgaattaatttggttttctttaaactggtattccatttttacatttttcttcttctttggttcattttccccctgattataaaagcaatatacgctcactataggaaatttgcaaagggtgggaaagtataatgacacaaggagagagaactactactcaaagggtatcatcactcttcactttttattccgcttccttttttttcccctatacaagatctgtttccaaactttattcataaactttcctctccttctactgatttttaaatgtaaagttgggtattttgggggttggttagggcactggatattaatgttgctcttcagtctccaaagcatgaaacttcaaggtaggaaaggtgcttaacggtgatttcatccagcaactcatcaactgagactcagacctcatttactgaagctctaatgattcatgcagaaatgtatagcactgagtggcaacattaactcactccagatctctctctcttcagagataccttgctgcttagagggaaacttgacactacccatgcctgcatatctttgaaagagaggttcagagaggagcaggagataattttcaagcatttgaagtgtatagtttcttttaggtattcatttttctgtttacattttcaggtttggggctttagccccttggagaaaacagggccacatagctgcctttctatcaagtctccctacaaaactgagaggctctgggaaactcagcctgtgaccccagcgtgggtgaagataggatcaagatggccatgtggcagggtaagaaattagcacttattcttctaactggtttttcctcctactctattctctaccctcacccaaccgttccccacccagccaatggcaggcagccagctgttctttaatttaaccctttgtctttgcagggacaaaacacattagtttaaaaagaagctgctgctagctataagtttaaattatttaaaagtggggttgtaggagaagtaggaaaatgccatgccagcagcatttaaaagaactcccttcatttaaataagtgatcattgggggttatatgccaggagacaggatattttttcccatttgtgtttttcatttgtttctggcaaatttctatcataagattccccaccataaggttggggagacagatgtcactgcctctccagcttcatcttcccaataaaaactttgtgatgtatgcagtttgaaagagcatatttaatgttacagtgtttatatttgatacaatataaacattgagaaggaaaacgcctgttttaataatatgaactacctgagagcaaagctcagtagtatcttagctgatgtattacatctctcatgaacttgtgaattcctaccacatacaaagttatgttttattttgagcggagttgcggtttgtgccctttggagggtttaggagtctccacgggtatgtgggatttttattgttatcaaaagtgagtgtgggtttaagaaatgatagacaaacactaccaaaattggcctgtgacccacaaaaagttaaagaccacttaaatggagtggaatgaaatagcttgaatatctagaaatattcagcaggttggttagttggtggtctaatgtatcttttaaaaatgtttcattgtgttggttgtgactttatgtaggcacacaaatgtaacaagtagtttccatgtataaagattatcaatgagaagacatttatggaaacgggatttggcctgtatgcttcctttgactcacacaatgggcatttatcaagagcagtttggatattcttgcttaaatcctgagacattatttcattcaacaaacgaaatacagagatgaataagttgcaggatgctagaagattccttgtcatctaaagacagacatacaaacaaataattttgccatgttgaataagtgttagaatagagaggtacaaaaagcaagggaagccccgagaaaagcttgatgaagtctgagttttgagctggtctaaaaaaatgagtaggagcaaatgagagaattgcattctgggcagacagagcagcactgtttgggaagttccaagttgctctgtttgcctcatgtgagatgtgtaggggcgcgacctcagatgaagcagggaaggtagttggaggccagataataaagagccttgtatgttctaggaaggattttacactttatcctgaagacaaagattctaaacagggaagtaacataatcagattttgttttagaaagattactttggcagcagtgctgagctggaaatgatgaaaactgggagtcagtcaggaggtttctggaatagtttaggggagagatggtaagggtctgagcagaagcaggggcagtaaggttagaatgggattctagaatgttctgtgactggatgtggcaagaaatgggcctggattaactaccagcttgggtgcctgggggccactggtgccattctctgagatggggagcatgggaggcagctgatgggcatgggggtggtgcactggatttggatgacctgtttgggttgagacacctatgtactgtcaggtcaatgtttcaaagacagttttgaaagtacagaactgatattggcacagatggggatctaaagttttgttcctaatgatgcataaagagcttgtatttttttctctgtagttaatggaaatgtcattactagttaatgatttattttacaataaaaacattttaatgtttaacaactcttaatcaaaatgtcatattttcatagtaaataatgtattttgcaagcccaggccctgaaatcagatgtgcttaaaattacattgaagtgaaacctcatttttccagcattagtgaagaggggagtattctatataagtaagctctttggataactgcagcttatcctttgttttggctaacctctgaagtaaccagcaaagtacgatgatagtttggaagcagtgtggtatgatagttaaatgtgtgggtctgagttctactccattggttctgtcacttggtagctacgaggccttgggcaagtaacttaatctctctgtgtggaagttttctcctttacaaaatggagatagtaatataactcatcccattgctgagtatatagccaaaagaaaggaaatcagtattgaagagagagctgcactcccatgtatattgcagcactactcacaatagccaagataggaaatcaacttaagtgtccatcactggatgaatggataaaaaacatgtgttacatatattcaacaaaatattattcagccataaaaagaatgaaatcctgtcatttgcagcaacatggatggaactggaagtcattatgttaagtaaaataagccaggcacagaaagataaatactgcatattctcactcatatgtgggagttaaaaaatgtggatctcatgaaggtagaaagtcgaatggtggtttccagaggctgggaagggaaggagtttggggaatgaagagaagtgggttaatggttataaacatacagctagagagaaggaaaaagttttagtattcaatagtacagtagggagactacagttaacaataattatatatttcaaaatggcttgaagtaaaaaattggaatgtttctaacacaaagaaaagataaatgttagaggtgatgaatatcccagttaccctgatttgatcattacacattgtatacgtgtatcaaaatatcacatataccccccaaatatgtacagctattatatatcaatttttgaaaagggagaaaagtagaacacctgataggcttggtgtgaagagaaattaagctaatatatgcagagcacttggaacatagtaaatgccatataagtgtatgccattattataatagtaaaacatttagaatattgtgtagcatataataagtgctcagtaaaatttagcaatagccgttattactactatcactattattttcttataacctggggtgggactgggaccttgttctgtggaggtaattttaggttgtccttggaagccctgtcctgtggttgtctgtttgggtctttaagtagaagtttagacttgaaaagattcttagaaaacatctagcagccgggcgcggtggctcacgcctgtaatcccagcactttgtgaggccgaggcgggcggatcacgaggtcaggagatcgagaccatcctggctaacacggtgaaaccccgcctctactaaatatacaaaaagttagtcgggcatggtggcgggtgcctgtagtcccagctactcgggaggctgaggcaggagaatggcgtgaacccaggaggcggagcttgcagtgagccgagatcgtgccactgccctccagcctgggcgacagagccagactccatctcaaaaaacaacaacaaacatctagctcaattcctagaggttaagtgatatgcccaacgtcaaacaggtagtagttgatcctagagctagtattaaaatccaggtcacctaattccctattccagtattctttccgtgggctcatggaagaggcaatgtgtgagtctgttctcagctcaaggaagcttctgagtcagtctgtagagcttgttgaggaaccctaagggctacaggagcccaaatctccttaggttcttggctcattgctgtctggttcctccatggagaatttgatctgaattcccatacctcttaaatggggccaacattattttgacttcacttaatggagccctctaatatattttctggccactttaaacagtgtactgagcataatttaatatttttgataactcagggttatcattaataacctccagccagtttgaggttggagacttgtgttgtcaggtgttgtttatttattccattaacatttattgaacactacttgtgcagcaggcactctgctgggccctaaagacgcaatggtcagtggaaacaagtatggtctctactgtaatggaacttaagaaccaggataaaggtagcacttcaaattaatgaaatgatttatttaacacatatgctgaagtaatttggaaaaaatgacagcataaatttagaagggttaatataatgtttcttaataaaggaggggacatcagaattacctgtagtgctttaaaaaatattcctactcaggtccccattcccccaaattgtgattcagtcttaagacctgagcattacaatcctgttttggaactgctgcaataaatataggttttttgttttttttttttttggagaaggcgatgataaaggaactcaaaaaatatggaagactatatatataatcttggggatagggaagatatttgtgtgcataatatcaaaggtagaataataaggaaaaagattaatataatcagttatatgaaaatttaaaatttctgcacaaaccataaataaagttaatgagaaaactagaaacaattgcagcaagatttattatctgtaacacaaagacttaacagggggataagaaaaaaacaagtattttactagaaaaatgtacaaaggacgagggaaaatgtgcaaaggaaaatacatcaaagaagaaatgcaaatggccagtaaacatgtatctcagtagcagtcaaataaaggggaattagaatggcataccattttctccagtataatttgcaaagattaaaaaggaatgacagaactcactgttggcaaggactcaaggaagcagatgttctcatacacttgtggtgggaatgtcagtttggcaatatttattaaaagctttaaaaaatatgtttaccttctgacccagcaattcattttcttggaatttatcctaaggaagtaattaagggtatgcacaaagatgtatcaataaggatattaattgcagcattttctataatgggaaaaattgaaaacacttgcattttgatgcatccatacaatggaatatggtaattaccaaaaatgataatgtagagttctatttagtaacacagaaataggttcataacataatgttaaacccaggggtcagggagtgggggagcagggaaaagcagattccgaactgttgatacagtcatccctccatgtgctcgggggatttgaagaccccaagtatactaaaatcctagcatactcaggtcctgcagttggccttacagaacctgcatataggaaaatttggccttccatattcatgggtgtcatattctgagattaccgtattttccatctgtgcatttggttgaaaaacatctgcgtgtaagtgaacctgtgcagttcaaacccgtattgttcaagggtcaactgtcattaaaagtatggactctgggcttaaatctgaattcaaatcccagctacacctttatcagctgtgtgctgttgggtatattacttgtcttagtgttccttgatttccccatcagtaaaatagggataaaatagtagctaacctaatagttcctagctagtgtgcccaaagatcacctggtgatctttccaaacttcccaagcctaggcctcactcagccaattaaatctgaatctctggggacgggacagagaacagtatttttgaagttccccaggtgattctaatgtgcaaacaagtttgagaaagccgagcagttgttgaggtgattgttgaagggattaaatgagaaaatcacagtgcctgtcatgtggtaagtactcaatacatggtaactattattattattgttgctatttaaaaattattaatagtatgatcccattttaatttatgtgtttgtgtccatgtatggatagtataaaaaaaagtctgagaggatatatgcaaaagtattttaaaaaagaaattatagttgactttatttttgcttacatgtatctttccacttttctgtaaatatcatggattgttaattttaaaaagtataatttctgaaggaaatatcagatatatgtacccagctttatatgctaaggtatttatagtgaaaaaactgaagacatagttttcatactaggggaatgtaagtatattatgatagttccaaacagtataatatctggccattaaaaataaagactagctgggtgtggtggcttacacctgtaatcccaggaccttcggaggccaaggcaggaggattgcttgagttcaggagttcaagactagcgtgggcaacatagattccatctctactaaaagaaaactttttttttttttttgagacagagttttgctaactagccaggcatggtggtgcacacctgtcgtcccagctactcgggtggctgacatgggatcactggaccccaggagactgaggctgtagtgagctatgatctcgccactgcaccccagcctgggcaacagattgagaccctgtctcaaaaaaaaaaaaaagactgatgctgtggggactccctctgtcacccagcctggagtgcagtggtaggatcttggctcactgtaacctcaaactcccaggctcaagcagtcctcccacctcagcctcctgagtagccgggtctacaggcacgcaccactatacttggctaatttttgtagtgtttgtagagacagggttttgccttgttgcccaggctggtctcgaactcctaagctcaagtgatccacctgccttggcctcccaaagtgcagggattacaggcatgagccatcatgcctggacccatctctctctttttaactcaagtgtgggtttatgtatctctctgtgtttacatgttacatatacacctatgaagtgaagataagtacagaaagaaaggaaatgatccaaagttgttgcactggctgtctccagatgatgggatacagttacttttatcttcctttttttatacttttatttactttcaatttttatgcaataatgtgtataacttttataacagaaaacaagtgatttgaaaatgagatataagagtcagtagactctcaacaagtacctggcagcaaggagcgcagcatgtgtggccccctggacaactgcttagccactctgtgtccccttctacgttccagcaaaagagcaaaagagaagaaaccaggcccctgagggtttggttagaacaggttttttgctattaatacttcctcaagtactcttgtaatttttggctgtctctcccattgactacaaaaaactcttggaagatgtgcaaaagatggcaaattacactgtatctaatgtagaggttgcagaataaggtgaggtggcaaaatatacgtcaggctaagtgtgaaaataaggcagaggaaaatcagaataaaatagttgcaatgagaaactgttcttcaaattgaaaggaagtatatgttttgactgtgcagatttttttttggcacattgcagtgtatttgtaaacactctggtgatttagccaacacatgggaggtggggagcaagagggagcctcacaaagcagtgggtgaattgacgagaaagctttagtgtgaaatctgggtagccatgtggcttgctaattggaccactgtcacctaagagaagccatctggtcctgcttgttgaccgaaacaaaagtaggtaactcttgaaagaaagtcaggttgttagagcaggaataaagaagcaggcagcctccacccccagccccttttcctttatttggcacagtgcctcacctacagcaggtactcaagaagcgaattctttgtcaattaaaataataaagaaataaatttaaaaaatttaaaaagaaatgagttccttgtctctcttcaccttttgcctttccataactcttcagtggggagaaattggtggggaatggattctgatggaagtcattgaatagagggtaaacgaaaacaacctttcaaaaaattattctctaagagtcagttattctttcccaagcacacagttgtggagggagcacaggtcttggagtgcgataacctgaatctgaacccaggtctgccatttggtagccaaggttatttaaactccagaagcctcaattgtcacatccggggtcaagtgtcatgtctggagacagactccctggatttgtatcctggctctgtcactactagccatgtgactttgggcaggttatttaatctctttgtgccttaccttcttcatctgtaaaatggggttaatactaatacctactcaggattattgggaggatgtagtgtagtgagtgaatacaaatgcagcaaagcacttgcacatgctggcctttataatatgtgaaaggttatgataatatttactgcacgtgcttctagatgagagtcagtcatcagaatgcctggtccattatagctgttctgattggattataagttttggcatgaaaaataaaattaggtatattattaaagagatttttaaactggaaggggtcttcagaggtgatctgtttcagatgtataatcttgcaaaggaagaaactgaggcccagtgagacttattttaggccacacagctgtcacatcgtacccaaagccaggactagaccctggggctcctgataatcagtgctgcccagcccgctctttctctgtcaatctgtctacctatttggtcctactgcattgcactgccttccccaggcttgggtatcttacagttttctgttgaatcttagtcttttcctactatgctttactgctaccgtgaaacgtttagttttttttctcccctcaaaaataggttttccattgaggcttccaggatgttttttttccccttcttctcactatgttagcttatgaaataaactataaattcttattatttaaccagaattatgattcagcttcctgtttcatgtaatgctgttctgtgtgtcaagggttgggggaggcaggactagaaagtttcattattggtggctacgaatgccagattctccttcttcttttccttcctaccttctcttaactacccagtatttatagacccatggtcaggccaaagaagctgttgaggagttaatagtatgaagtgtctcccttagtaatgtcatattttgatgattttcaacccaataccattctggcattaggtggcaatttattatatttatttaggatttctgccctgactacatccaggaggaacatagaacaacacagaaattaaaacatagagcaattagaaataaatgcaggacagggaccatccagtggaaatgaaatcgatattactaggcatgtgagatactagacactgaagttttctctttcttttcttctgtgtccctccttcccaaagacaagcacgataagttacatcgttgacatcttctggccaaaaaacgtgttcagatgcaaaagaaaaccctggctctgtctatgctaaatcttctggcccttccactgccctccctttggtctggccttacctgtggccacctgtgactcagcactgaatattcccaggttgaaatcatgatctttcctgtttagctttgagaatggtgagagacaggtaggcaagagagttcctgccatccaaattctcaactctgtcaagctattcttttccttgggtcctgtaccccagtaatacacaataataacagagtttccttatcttacattcctctgtattgaataattgtaccaccatggacccagatgtcaaagcccaaattctaagagacaccatgcatttcttgctcccccttacctgcagtccacccctgctggcctagatcatttcagttggtaacattcctagcaactacctgcttatctttcagccatgagcttttcctgaagcctccccgatcctctggtaaaattggcttctggctctattgtatggtccttgagggcattgactgcacttgttcaatatttttgttctcacatctgctgtgtgccaggcaggcactgtgttgggtggatgctggggttaaagcagtgaatacaaaagtcatgatccctgccctcttaagccttgcagtctcatgggggagttggagtgcaaataaatacacagatattttcttataaagtgttgtgagtactagaaaagtcaagtcctatgaaaaagaatagtagagactgaatttatagagagaagaagggaatgggaggaagtgacaagttcatctgagacctgaaagatgaggaggagttatccacgcaaagagttgggggaacagcatcccaggcagaggagacaaggtggaaatccctgaggtgggaagaatccctgggtcctttcccagcatggtccattgcagcaggaccatagtgaatgaggcataaagggacacatgataaaattggaaaggtgggcaggggacaggccacacagggttttataggccatgttaccaagtaccctaacttggtaacatgaaggccttggagatagattggatatggcagagtgaccagtgaatgaatggggagtgtctcattcatcttctcataccaaatacctggcagagagtgcccagcacatagtatgtgctcattgaatctttctttaatgagtaataactgccttgccttcctatcaggattgccatggagattaaatgagataaagtatgctaaggtgctttgcaaaataattcactagattctatgtagtgatgcttataggttttcactgtcactaggaaccacatccccccaaccccattctctgttaaactagcaaaatctttcaattagttcatcccatgccatgaacatgctgatgtactgtgttcttacatattcaatgtgtctctttgatcaatgcctttaactaattatgggtgagtggaaactcccttatatcacaccattttgtggcactcctggtgttagagataattatgggtagtggtgccaggagcagtatagctttctcttctatgctaaatctacttctaaatctctcaacctataataattcattatttaggagctgggttaatactgaggaatagcattctttgaatttgcgtttggatggggcaaggctaatcatatcaggatgtggttggtaccaattatggcacttggttttctagactgttaaaagacataacaaaatgatcagtgttttgctatttttatgttaaatatctgttccctatttaaactgcaagaacttcagatgattgactgaaaagtccagctccgtgcactgttggtaggcatataagttggtagaatccattagagcgcactttgaaagactttttcaaaatgtaacttgtacaacttttgtcccaatgaatcttctcaaaaggaactgcatgaaggtcacttgttacaaggatcttggttgccttctagttgccatctttttactatcaacagtcttattaatgtacagcatgagagaccagtcatgttaattatgatatttacatactatggaatgctgttcatttcatttaaaagagtaaagtagcctggacgtggtggttcacgcctgtaatcccagcaatttaggaggcttaggtggaaagatcacttgggatcaggagtttgaggctgcagtgattgtgccactgcactccagcctgggtgatagagtaagacagtaaagtagatgtacatatagtgacagggaatggtgtccaagataaatttttaagtgaaaaaaggggtgcagaatggtatatattataggatcccacttgttcaacacaaagaagggaggtattatttaagaattcgtgtatatgtgttcttgcatatgcttagaaaatttctaggatgacgcacaagaaacagttgtcagttaccttggagattagaggtggcaaggctagggattttagttttcacttgacacctttctgtacactgctcgacttgtttacaacaacctgtaaaacctttaaatactaaaatttaaataaaaactttacctcactagattatttcctcgacaatttatactaagaaataaaaggaatattagtggttgaggtgagagatcaggtctgaagcaaaggaggctgactctgataaaaccaagggcctctaaaagctacctctgtggccagaggacttaggagagatgttgctttgttaaagcgtaatgctaagaaaacaagtaagattaaattgggtaaaaattactttattagttttttgatgaaacagttgtaatcatatcattagttttgatctctgggtatattaataactaaacagcatagtaattgtattccagactacaatttaaaaattaaatgtttcaatgtgtagaataatagctgtttttcttgtttgatttgtttaaatgttgcaagtgaatgctaagctacaatttcttgagctttttacttaaggacctgaggaaaaatgcaagtataatcttatgcttgaagtagagaagatataaattacctaatatttacctgataatgtttggattaagttaaatcttcaaattcttaaggccccttctagctcagtctcccccaaaaagagggtttttgtctgagatacaagaagtcaaagggttgtctgtcagaatgtcctcttggtttggcataatgaagagagttccttcacccagttgtggatgttcagagacaagagtcactatcctgtgttaagtgaccctgcttctctaatatttggggttttagccaggagataggtggtagaacacaagacaggttttactttaagatattgattattgtgaaaatggccatactgcccaaggtaatttatagattcaatgccatccccatcaagctaccaatgactttcttcacagaattggaaaaaactactttaaagttcatatggaaccaaaaaagagcccacattgccaagtcattcctaagccaaaagaacaaagctggagacatcacgctacctgacttcaaactatactacaaggctacagtaaccaaaacagtatggtactggtaccaaaacagagatatagaccaatggaacagaacagagccctcagaaataatgccgcatatctacaaccatctgatctttgacaaacctgacgaaaacaagcaatggggaaaggattccctagttaataaatggtgctgggaaaactggctagccatatgtagaaagctgaaactggatcccttccttacaccttatacaaaaattaattcaagatggattaaagacttacatgttagacctaaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaacccccatcagagtgaacaggcaacctacagaatgggagaaaatttttgcaacctactcatctgacaaagggctaatatccagaatctacaatgaactcaaacaaatttacaagaaaacaagcaaccccatcaaaaagtgaccgaaggatatgaacagacacttctcaaaagaaaacatttatgcagccaagaaacacatgaaaaaatgctcatcatcactggccatcagagaaatgcaaatcaaaaccacaatgagataccacctcacaccagttagaatggcaatcattaaaaagtcaggaaacaacaggtgctggaaaggatgtggagaaataggaacacttttacactgttggtgggactgtaaactagttcaacccttgtggaagtcagtgtggcgattcctcagggatctagaactagaaataccatttgacccagccatcccattactgggtatatacccaaaggattataaatcatgctgctataaagacacatgtacacgtatgtttattgcggcactattcacaatagcaaagacttggaaccaacccaagtgtccagcaatgatagaccggattaagaaaatgtgacacatatacacgatgggatactatgcagccataaaaaaggatgagttcatgtcctttgtagggacatggatgaagctggaaaccatcattctcagcaaactatcgcaaggacaaaaaaccaaacactgcatgttctcactcataggtgagaattgaacaatgagaacacttggacgcaggaaggggaacatcacacaccggggcctgtcgtggggtagggggtagaggggagggatagcattaggaggtatacctaatgtaaatgatgagttaatgggtgcaacacaccaacatggcacatgtatacatatgtaacaaacctgcacattgtgcacatgtaccctaaaacttaaaaaaaaagttgcccggtagtctaactttgtcatttattcctttgtgctttgtggtatctcttacatttatcacttcctttaaattccaaagttagcatcttatatacaggtacttagaatgttctacatgaatcttattcagcaatctcttaactcatcaccccaattccagtctcttttttccatctgtcctgcatagttctgaccatgacagctctctgcccaaagcccttcaattgcatcccactgtatatggaatgaagtatgaatcttttagttttgaagccagaattggattcaaatcctagctccaccaactcctagctatgtgatgtgaggcctcattttgtaacgtgttaaatgggaataataacaactgcctcataggtcctggttttcctgggcccctgtttattcctattccatctgattcatactccactctccaaagtgtcctggttttgacaattaaatcatttggtcaataaagggttgttacaaaaagttaatgagacaatgtatataaatataacaggcctggcatgacactttcatgttccctcaaatgtacctggtactttgctgactgaaatcatatctctgacatctccagctacagaagaacctacccatactgcatggtcttcctcagatgctacctcctcaccttcgtctaacttctgtggtagtccacaactctctaaccatgtctctaacataagtttgggttatggttattagtgcacatgttttaacttcctcagagactagcttttggaaggacggtatctgcttctgaatcttcttagtcccacccataatacctaatagtgtcttccacacagaaaatacaaaatcacttatttaaatttagaaagaatatagcattttggctacaggattgtatttcacttacccacgggctttattcaagcctctgctttctcactcccttgaaatgatttcacttgctcgttagggccacagcaagagtactctaataggaaatttctttcacagctggccattaccttgattgattgggggtggcagtgaagaagggattctgggagctatggtcctagaaatacagaataactaaaagcacaggttctagagccagactgcctcagactcaggctctaccagttacaatttcagaatactacccaaccactttatgcctcagttcctatctgctataccattactggaaagattaaatgagataatccatgtaaagcacttttaaaagcacatggtaggctgggtgtggtggctcacacctgtaatcccggcactttgggaggtcaaggcgggtgatcacttgagaccagtttgagaccagcctggccaacatggtgaaactccatctctataaaaatacaaaaactagccaggcgtggtggtgcatgcctgtagtcccagctgcttgggaagctgaggcatgagaattgcttgaacccaggaggcagaagttgcagtagcccagatcatgccactgcactccagcctaggtgacagagcaagactctgtctcaaaaaaaagcacatggtgagtactcataaatgatagctattattattggttcttttctctttcttgacctcagtcaactcagaatactttattatggaatgagaaatgtaagcaacatcctccgtgcagggcagtcaagtacaggctttgatcacatacaaagtccagcccaatcagagctcagcatcttctctgtctttctaggatgtctggtttcttctcccaattcttccctccttcatgcccagtccaagctgaggccagttctaacagcttctgtgatcaccagcaaagataagaatctttctgcctcgttctctagacataacctccaggtccaggttcaactgcaaaccaaactccaggcagctcctcatattctggttcccacaaccagaaaaaatatctcaaaagttgcattatttatgattccagtctttctacccgattccagtctttctacagcctgaaattacatagccttttcctttctcacaattgttcccattactccagtctctaccacctgccctattatgtctttctcaatcaatatcttttttttacctgcccaatgatatatctttctcaatcagtatctttttttttttttttttttttttggcaggaaaatggggctgtgtgtttccctgccccacccaatacacacattcacaaccactgccacctgcacttctctgggcactcaaggtggcacagtagtcagggcatttctggagtctttctgcctctgtatcccccaccccagttttgaactcaataaattgaacaccatttattcttttttttaatcttgattaatgtttaattcaacaagaatgccactcgaattcattctaatttatctgaaatacttgtttgaattaaaatgtcctttcaaattcatatctagtactccaggaagtaaagcaaagaaattttgatggataatgtagggcaatgagtatagaatcttccccacatcaattgatatccacttaatactgtgaactcttccagctaataaaggcttgtcttgactttctgagtatgttttcctttgatggtcttatctaggcaaatttttaaaaattattattatactttaagttttagggtacatgtgcacaatgtgcaggtttgttacatatgtatacatgtgccatgttggtgtgctgcacctattaactcatcatttacattaggtatacctcctaatggtatccctcccccctcccccctaccccacgacaggccccggtgtgtgatgttccccttcctgcgtccaagtgttctcattgttcaattcccacctatgagtgagaacttgcggtgtttgtttttttgtccttgcgatagtttgctgagaatgatggtttccagcttcatccatgtccctacaaaggacatgaactcatccttttttatggctgcatagtatcccatcgtgcatatgtgtcacattttcttaatccggtctatcattgctggacacttgggttggttccaagtctttgctattgtgaatagtgccgcaataaacatacgtgtacatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttcttggctgcataaatgttttcttttgagaagtgtctgttcatatccttcggtcactttttgatggggttgcttgttttcttgtaaatttgtttgagttcattgtagattctggatattagccctttgtcagatgagtaggttgcaaaaattttctcccattctgtaggttgcctgttcactctgatgggggtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatgtaagtctttaatccatcttgaattaatttttgtataaggtgtaaggaagggatccagtttcagctttctacatatggctagccagttttcccagcaccatttattaactagggaatcctttccccattgcttgtttttgtcaggtttgtcaaagatcagatggttgtagatatgtggcattatttctgagtgctctgttctgttccattggtctatatctctgttttggtaccagtaccatactgttttggttactgtagccttgtagtatagtttgaagtcaggtagcgtgatgtctccagctttgttcttttggcttaggattgacttggcaatgcgggctcttttttggttccatatgaactttaaagtagttttttccaattctgtgaagaaagtcattggtagctggatggggatggcattgaatctataaattaaccttgggcagtatggccattttcacattattgattcttcctatccatgagcatggaatgttcttccatttgtttgtatcctcttttatttcgttgagcattagtttgtagttctccttgaagaggtccttcacatcccttgtaagttggattactaggtattttattctctttgtagcaattgtgaatggaaattcactcatgatttggctctctgttggtctgttattggtgtataagaatgcttgtgatttttgcacattgattttgtatcctgagactttgctgaagttgcctatcagcttaaggagattttgggctgagatgatggggttttctagatatacaatcatatcatctgcaaacagggacaatttgacttcctcttttcctaattgaataccctttatttccttctcctccctgattgccctggccagaacttccaacactatgttgaataggagtggtgagagaggtcatccctgtcttgtgccagttttcaaagggaatgcttccagtttttgcccattcagtatgatattggctgtgggtttctcataaatagctcttattattttgagatacgtcccatcaataccgaatttattgagagtttttagcatgaaggttgttgaattttgtcaaaggccttttctgcatctattgagataatcatgtggtttttgtctttggttctgtttatatgctggattacatttattgatttgcgtatgttgaaccagccttgcatcccagggatgaagccaacttgatcgtggtggataagctttttgatgtgctgctggattcggtttgccagtattttattgaggagttttgcatcgatgctcatcagggatattggtctaaaatacacccacttttatatcatattgcaaagtagtcataatatttatcatgtgatatgttatcaccctcttctgaactcctgcgtctgttattacctttaactagttgctagataaattgtaatgccagctttacatcttttctgccattgtcttaaactgttatttaacttctttattatggtttaactttcttatatgtttatgttagctccccagtagagtggaagatactttagagataggaacatagtttatacatccctctattcctcctaattccttaagtagagtcacccaggaagtatttattgatctgatttaaccagttcatgtggcacaataagactttttgttttgtacattataccctgttaatatggtcgcaaatagtattgggttttggataattatttcttagtatgaactcataatgagcccagaacccactttttcctccaagtttctgtctgtccctttctcttctaattttttcaaaaatgtgcatgtcatccctgtgcagggaccatgctaatcttctctgtatcattctaattttagtatatgtgctgctgaaataagcgcctttcgattttttttttttaagatggagtcttactctgtcaccaggctggagtgcagtggcgtgatctaagctcgctgcaacctccgactccctggttcaagcgattcttctgcctctccagtagctgcatttatgggctcgcgccaccacgcccagctagtttttttttttttttttttttttgtattttaagtaaaaacggggtttcaccatgttggccaggatggtctcgatctcctgacctcatgatctgcccgccctggcctcccaaggtgctggcattacaggcatgagccaccgtgcccggccgccctttcaattttttttttggagacagagtcttgctctgtctcccaggctggagtgcagtggcacgatctccacttactgcaacctccgcctcctgggttcaagcaattctcctgcctcagcctcctgagtagctgggactacaggcacacgctgccacgcctggctaattttttgtattttagtagagacggggtttcactgtgttgcccaggctggtcttgaactcctgagctcaagcaatccgcccacctcggcctcccaaagtgctaggactacaggcatgagccactgtgctcagcctagttttttaaacaagaacccttctatgcctttacttaaatatcaatgtaattaaattttgatttattgttcctcttgttagttttagctttattatcacatatttttcataaatatctttgtccaagtaattaataaaacattgtttgctatatttgttttccgttgctgcataatgaattaccacaaacttaattgctcggaacaacaaccatttattatcttgcagtttccatgggtcaggagatggtcgtggctcaacttggtcctctgctcagggtctcacaggctgcaatcaaggtgttggcagagctggtggtctcatctcaggctcggggttctcttccaagctcatgtgattgttggcagaatttagttctttgtggttgtgggattgaggccctcagatcctaggggctgcctgcaattccctgtcacatggtctttccataggcagttcatataacagcaccttgctttttcaaggccagcgagggataaagtctcagtttgtctctcacaatggcaagaaggaatcaataatatacacatatatacctagtcatgggagtgggttctcattacccttgccatattctattggttagaacctactcacatgtcccactcatactcagggaaaggtgattaaacaaggacatgaataccaggaggtgggcgtcattgggggtcaccttatggtctgtctgctatatttggcatagctctgaatcaggctaattgaagactttctttttttctttttctttttttttatttttattttttgagatggagtttcgctcttgttacccaggctggagtgcaatggcgtgatctcggctcaccacaacctccgcttcctggattcaagcgattctcctgcctcagcctcccgagtagctgggattacagtcatgtgccaccatgtgattttgtatttttagtaaagatggggtttctctgtgttggtcaggctggtcttgaactcctgacctcaggtgatctgcccgtcttggcctcccaaaatgctgggattagaggcatgagccaccgcgcctggccaagactttttaacttactgttatccatcaacaaacactcacttgggtaaggctgctctaacagctgtgactctaactttactgtcatccaccaaatgttttttcatctacttacaaagataaaatgagagatgatgttcagtagtttgcctgaagtcattcattgtgtggggccttccactgagacagagtgctggagtgggagcaaagttgagatgatttgaatttgggtgcctatcagatatccacctagagatgttcatttccccatggcctggggtatagagagggtctgggctcgagtagagatttgggatccttcatgtatagatgatatatgaagcctaggatatgagtatactttgagagggaaaaggtgccaagggtagaattctgggggaaatccaggtactcagtttgagggatttccctcacctccttatatagcaacccaaacaaaaaggaaacaagttatccagcctcagaggaaaagctgtattattttgtctacttctgcttcagtcccttctctgtttattgtagatactacttattcaattatacctcttttcttctggtttcttcttctcttcctttccactggacccattcgctgtcgtccataaacatgttctggtcttcgtttgctgtatcttctagctaccagtacctatctagtcagccacttaatttttctgggcctcaatttcctcagagattgagggacgtgatgtagggaggaggttatgatttttaagaagcctctttctgacctaaattctgttctgccatcttatttctctaccttttcccgttttgggttgtgttgactgttcagttcctttttgaaacttccctcccttggccacagagttgtactcctctagttccctttctgcctgcctctgtcactgcttctccattacttttgtttcctcctgcctcctaattatgtccatattcaggggtgtaaagttctttaccttttttctctttatactcactgcctcagaaatttcatctacactcctggcttcaccttttttttttttttggtttttaattatagaagtaacacacaattacatgttcctattaaaaaataatatagatgcatctagagtaaaaagtgaaaatgccccttcaacctcatcctcagacgtaaccaccattatcggattggtgttctttctccaggtgttgagtcccagatctataaaggtagctctaaactctagatagctgcaatcaggatacccttacttggatgctccactatcagcatataaaatcagctagctgaatgactttgggcatatggttgatgtgttttttttttaattctgtggttctttcatgtcttatatttatttctttttgtgtctccatagcattaaacggtagatattccttacatgtttggttgattctgttattttgcagctgataacctctcattagtactccttcccaatttgcttatatgcatagacccaaggaaatagaataaccctctgtcagtactttagatgaaaaggtgggtggctgagtatagggcttaatcactgggaaccagaacacatgagcaattcagcaggtaacagtaagtatgggggcttaaggagaatggggtggtagatgggtagtatattgaaaactttggtcagtaaattaaagccagggtgctaacattaaatatatcatgggttgtaaaatataaatatcttaatctaaaatattagctaccaaaatcactgttcatgtgaaaacattgttttggctctgaaaaagatacatggataatctctgcagtgtaatgggtcattttgcaaaagtatattctactatatgtgtattaaatgcaaattaattggaaagattgccaatgagagtgtatcattgcatgttgtattaatgaggctgtgttgcataagcagttacacactgaaaattgccagtctctgtaaaagcttaattccaaagaaatttaggataatcatggacaggatccatagtagtggttctcaactaggggcaattttaccccctggggacatttagcaatgtctggagacatttttgtttgtcacaattgtggggaggtgttactggcatctagtgggaacaggccaggtaagctgataaacatcctacaatgcacaggccaactccctaccatgaagaattatctgacccaagatatcagtaatgctgaagttgaggaaccttgatgaagggaattttgggtagggcaggagatccatggcggtgaccattgatgcccctttgtattaatgctgatgtcctgtaattcttaaccttgctacctagttgaaagctagaggatatgacaattgtttggcttttaataacagcatacatatcagatagatggacaatttattttcttttctaggtgttctggttatttgactattaaagtaaattatccccagactttttcagtgctgattttttttcaaggggaacttaccgccagaacatttaaagagcgacagacaaaaatgttgagacttgataaattttatgttgagttattgcatattaatacttagtcctaaatactgtacgtgaatgtatcttaaactgtgatatagctcaggggtgtaaatgagttgccttaggtaatgtagtgatttattcatagacccaaggccagaaatcagattccttgattcccagaccattattccttcaatttggctatggcttctgtataacatcttttctgctttgagtctcctgaagagcagaatcaagtatgtcaaaaattgaatgatcttaggtgctggatgttttgcacatttatgcaagaatattcaatgttaccagtcatcttaaaaaagcaacaaaataacccaaaataatgctgagtaaaacacaagaagttatgttactttttcacttggtgacatggatgaaatattacagcaaatggggacagagcttaaaggaagtggtagggtgaaaggaccgttagtataacacagctggatggcatttctctaagctaccattttgaagaatgttgctctttggactgactcccaaactccatctggctagcactttggaattttaaatgggtaaaaaatatgattttccattgctcccagctgccctgcatggtttaatagacaactatgtaaaagacagggagtagaaccagcatttgatttgctttatgaaattgggaaatacacttggttttttaagctcaagttttttcataggtagatgatatggtggaggattatggtagttaatatttattgaatccttacaatttatcaggtactaagcccttccacatattattaaacctcaatatagttctataaggtaaataccatattaccccccttttaaagttgagaaactgaggcaaagagaaattaagtaactagctttcacagctaataagtagttcctggtatgaattgagatatactgtaagtgtaaaatacacaccagatttcaaagacagcatgataaaaaaatgtagaatatctcaacaatgttctgtattgattacatgttaaaatgataatattttgctttttttaattcttagtttttgtgggtacatagtgtatatatttatatacacttgaaatattttgatacatgaaatattttggtacatgaaatattttgatacaggcatgtaatgcatagtaatcacatcatggagaatggggtatctgtcccttcaagcatttatcctttgtgttacaaacaatccaattatactcttttagttctttaaaaatgtatagttaaattattattgacttatagtcaccctgttgtgctatcaaatagtaggccttattcattctagttatttttggtacctattaaccatccctacctttcccatagtcccccactacccttcccattctctggtaaccacccttttactatctatgtccattgaagtaatattttggatatattgggtcaaataaattagagcgttaaagttaatttgacccatttctttgtgcttttcttaaggtggcatccagaaaatttcaaattacatatgtggctcacatttttatatttctgttagacagcactgctctagaggtgggtgatatctcatccttatatcatgtacatgagactaaaggctgaggaagccaaaaaattaaatacattggattaaagtttgctgttgtagccattaagtctctaaggtgacattaggcctattctctaatgtttgcattattaaggggtaaggaacaaggaagcttttaaacttaggtacattctagagttttagtcccatacacatctgttgaataactgtgtaaggcattgtgttgatactgtggctcatataaaaatcagtgacttagactttgccatcaaggagcttataatgtggtaaaagaacatgtacacacacaactgtacataaaatcatatataatggagtggtagaaacaaagggcttagaatcttaagagtacaagaggttatttgcagctagcatgagggtggaaggtttaggaaggaggtgacatttgagctggttggagaaagatggataggatttcagtagaggtcccctctatactcaaaggaacatgcagaactaggtgacaggtcactgagctgacatgcttttctcttcaccaaacggaaactctgtgtggcacaaaatggagagaggtcagataccttgacatgtgggttttttaagggcccatttatgttgatatgccttcctcatcagacccctgtcttgcatatacatagaaatttccaatcatagaatacactgcttatctaagtcttttggtttctgacatcctggatcagccaggcagcaagtgatgaaacacacatatgcctgtgcatatgtttctagttatgcatagatgaatgggcaggcagataaattgtttttaaactgtagttaaaatggccccatcttgaaatttagatttaacttgaatttctcttgtctaatctcttgggcaaataattgtagctcctaccatggggaagaataaagaaaggggcagaaagaggctgggaatgttactctaacagaagtatctctaccttgaagtgggaacagtgggggaaaaaaatactctcctcactccaccagtaccactatgttcaagtctggcctttcctttcagctaccaattacttgtcaaatggattggtttggttttgtatggaggtcatttggctttaccaaaaaaaaaagggaaataaaagactattattttcaagataaaacctggaaagaaaagaacctatacccttaagtaggaaggactctccagtctatatttgcagacgggctgactttgtcttccaggtgggtttttttttttccagttgtttgttttatgctaatagagttttgccccattaacatagaatatgattcagtgactccttcctgctctccagaggacacctgtacagttaattggcttttccttttatagaattctaaaatgttaaagctacaaatggatactcttatagaatgttacagtagccaaatcccttagttaaaaatggtaatgtagctcttctctttaaaaaattaaaaataaatgtaatatgttattgtaatatgtatttaaccagttttaaaaattagaaaacataaataagaaacaacaaattttaacatcccagatttaaaaagagagagaaccattgttaacacccatgcatatagacttctagacgtgtgtgtgtaactttttttttttttttttgagacggagtttcactctcgcccaggctggagtgcaatggcacaatctcggctcaccgcaacctccgcctcctgggttcaagcgattctcctgcctcagcctcccgagtagctgggattacaggcatgcaccaccacgcccagctaattttgtatttgtagtagagacagggtttctccatgttggtcaggctggtcttgaactcccagatcacagatgatcagcctgcctcggcctcccaaagtactgggattacaggcgtgagccactgtgcccggccgtgtgtgtgtaactttaataaaaaatggatcacatcattttgtaaagtatctttttcatctttacattgtagatatgtttctatattgacacctcttcatctacaataacttttttgtgtttttgttttgttttgtttgagacgaggtctcactctgtcgcccaagctggagtatagtggtgcgatcacagctcattgcaatcttgaccacctgggctcaggccatcctcttacctcagactcccaaatagctgagaccataggtgcaggccaccatggccagctaattttttaattatttgtagatatggtttctcactatgttgcccaggctggtcttgaactcctgaacttaagccgtcttcctgcctcggcctctcaaagcattggggttataagtgtgagccaccgtgcccagcctacaataacacttgactactccattttattgatgtaccacgagttatttaattaatccactgttattggatatttaagttgtttccagtgttccctatcattacatgtgctacagtgaatgtcctcatacttaaatctttctgtatatacttaatgtttgtttagtataaattctaaaaagtagaattggataggtaggagggtgaagattgatcaatgtatactatccccagtagtcaactgaactcttgccaatcctgtgtattctcgttcagaaaatgcttgtcaatttggtaagtcaaaaagggctttttgttgtagtgtattcctttagttacgacgatgttggactttcttcatatgcttatattattgacagttctttattgggcacttttaaatttatttataagttatttttaaggatagtgactctcataatgttgcacaggttgcttctcagttttgatatttgctttgtaataaatttatttttaatgtccatgagttttccacttttatacagtcaaatgtatcagccttttcctctatggtttgtactttacacatatctcaccacagagcaaggaattctaagggccaaggagatgtgcctacctgcctgtttcttctagaccaagcttgtgcaacccgcggcctgtgggtcacgtgcagtccagtacagctttgaatgtggcccaacacaaattcataaactttcttgaaacattatgagattttaagatttttttttttttggtcgtcagctatcgctaatgtattttatgtctggcccaagataattcttcttccagtgtggcccagggaagccaaaagattggacacccctgttctagaccatactctaggtacttggaagctgaggaatctctattcaatgtgcttccagggcttgcgagggcctctgccctggatctgtcctctcaaggagagactgtgccatatgtgtgagctcttctaggtctaaggggtctaagggggtgcttgtttggtgggagaagtgtatggatggagcttggctgtgtggactgagtggtctacacacaggcggccaaggctcctagctgtgtaggaaggagtggggtagtggagagaaggaaggagaattaagagcctatacttacattcttgcccctggccttgtaaatattagggatggacctatttctcatagtaatagttataattttagttacagttaaagattgaatctttgtggcatttcctttgggataagatgagatcaaaaaactaacttttcccccaaatgccacccctttcttttgtagatggggaaactgagccttaggctgtaattggtccagagtcactgggctggttagtggcagagctgtttcttatgactgatagagtagtgctgatttttttttagacagatagacctgggtttaactctgggatctgttactaactcgcctttcatgtgttgtgcaggacaggtcacttaacctctcagagtctctaattaagtaaataagagaatcctacccaccacctatccctgtgccaccaccattccacccaactagctgcattttctaggttatgccccttgtaggcagtgtcgacctcagcctcttgcctcgttttgtggactgactgttgcctctgtttctaaaacagtcaaagctctatggcccttagttgaaacctgtaccctttaagctccaaccagaaccctgaggatgggaatacacatatctgtagacacccaacaaagtatttgtgttttacagagttggcatgtttttttttttttaacagcttccgattagctgtttagtcaccccccagcccatgagtcccccatgaggtaccataagcatagccactgtaaaagtctctgataatttgactgcttttgaatactccttgtttattataatgactttcgtgtgctttccactgttcaatttatttttcagacattcatctagatttgactcagtatctttacattctgtctttacttttaatgatgtacttactgtgtactccaaagacagttcaacctagcaactattaaactgactttcaacatggcacgattctttctttttttaatatttaatgaaggaaagccctactgctctatttccccagaggtagaaatctcaatttatgttgtttgagctgggagaacttgttaattaaaactgtcgaactgtagtgaattttgctattttaatatatgtttcatcagttgatgggggcaggggttggaatagtaaagagtacacagatacttttgtgatttggttatgatgagactgatcttctaatggatcttcaaattgacaaattctgggaaagccaaaaaccaatcccaatctgtatagaactgtaccactattccaaaggtctgtcttaattctttgagcctgattctcttgccttcactctgctttaggaccagtctgctttaggacattagagctaatattagccttagactggagccatgccacttccagaagggttccacactgggttttgaatccaaacaggcctaatcttccaagattcttaaaatcctattgtcttacctttgatctagtgcagcctctgactaaggctggcatgccactcaccctgcagtggccttagcaggtgattgttccagctaccccacaagcagtgactctggagtgggtctgcctggatttgaattctagctctgacacttgactagctgtggttatagccacattttactcctctgtgcttagttttatcatctgtaagatggggatagtagtatctgcctcacaggagtgttgggatcattaaatcagctaataaatgtatagtactaatgtctactagcctattgttgttgcttttgctgttgttattccgttgtcatggagattgaaatgcttgaaaatccttccttatattcagctgaaacctgtctctgttatctctaaccactgtggctgcacagaggaaagtataaccctttccccacttgctagcctttcagatacgggacaggtaaggacacatgtatgaaagcacattgtaagctgtaaagtgatgtgttacctacaacaaggtatttaatattatcattatattttaacctacattataattattatctaacttgtcctttctatctgccacatcttatcttttaaaaactgcatactttgcgttccttctagcgttctttatatgacatgatttccagatatttaaccatcttagttgccttatttgggatatactcaggttcattcatgtctccattaaaatttggccctcaggaattgacttggtcctgtataggcaattgagctagtacagagcacaacaataatataatatttacctctcccctctcttaaaaaatacataccttgtggccgggcgtggtggctcatgcctgtaatcccagcactttgggaggccgaggcgggtggatcacttgaggtcaggagttcaagactagcctggctaacatggggaaaccccatctctactaaaaatacaaaaaattagctgggcgtggtggcatgctcctgtaatcccagctactcgggaggctgaggtatgagaattgcttgaaccccggaggtggaggctgcagtgagccaagattgcaccactgcactccagcctgggcgacagagtgagactctgtctctataaaagaaaaaaaaatacataccttgttaatgaagtggaatattctgccagtttgagggaatattatcattctgttgactgaagagctttttagatgaagtcccattaaactgttttaaccattttaaaacttgcatccacttattttttcactagataatttttgagtcttctttgtgccaggcactatgttgcattctggggatacaatggtgagttctacctttatctccattacctttcagttcctagcctcgcctgttggtatttttggattctagctctatttgaaacacattggctgtgtctccatgttttatatcattcatgaattttatgatcatgtttccgctgtcttttctaacttggtggtatttcagtagtgccaagtacagagccctgaagcattcaagttgatcttctgtgaggctgacattgatccattaattggtattctttaaaaactctttttattttaaaaacaattattgattcagataattatggttactgcaaacaaatgtacagggaagtctcatgtacccttcctccagattcctccagtgatagcatgttacaaactatagtacaatattgaaaccaagaaactgacattgatacaatccgcagggcttattgatagagaggtggagagggagagagaaagggaatggggggagggagggagagagaaagaaatgagagaggctccatgcaactttatcacatgcagctttgtgtaaccatccccactatgatcaagagactttactatcactacaagacttccttttgctgtccctttatatagccacatcccttcctcctcctcatttctaatccctggcaaacactaatctgttctccatctctataattatattattttacaaatgtcacataaatggaattgtgcagtatatatccttttgagattagttttttttttcactcagcataatttatttgagattcatcccagttgttgcatttagcaatagtttgttccagtggcattcttgttgagtaaggttatttgatcaatcataaatcatcctacttgttcaggacatacctgtctcatatgaacatattctatagggaaaaaatgtcttcagtgacttactgaaactcaaaaacacttcgttccattacctcagtctatgattctcatgacctgatcattgttcataaccatctgtttactagttcattataaactgatttttttcccatcaagattagcagtctttgttttcagagccatttcagaaataccccagctttttagttttacaagtaacagccaaatttttctagtctgctatgatttttttcagagattaccagcagtggcctctcaatcaggacagtaggttatctcaatactataagatatactttatctgggcctacaggtccaagttcatttgaaactgcttgctactctcactatctctacatcagttgggctgtgatgaactcttattcacatttgtgctactgtttccagtttgaaaaattattcttatcatttaagatgaaatagaaatagcaactgagtcattctacttgcttgctcgctcgctctgtctctgtcacctgttcacatatatcttctacttagggtagatgatcttactttgaaaaatctgcacctgctatagctacattagttcctgtagcctaaaagcttgttttctgtgcagcttatgttgtgttctttagtcacttctcctttttttttcttcaagatcatgggggattgataatattttgagacctatcctcccaaatattttattcctcttacacattagtccacttaaggttcactgtggtctcttgtagaaattctcattctcagtatctggggaataccttcattccctgttgtttttgtttgtttgtttgtggttattacccaacaatacttaaaatgacatggccatatttcctaaagtttctttcacttctacttttaccaatcagttcttctttcttggtcaaacttagttacaaagtttgtagttcctctcattgctttctcggcatcctaaagtatggaattttccttttataagtgcaacgcacaccttcccctttcataagcatgttatttcctggctgacattcccttctcagttctcctgtgccctcccagaactcttgttccttgatcaagcatgtccatatattcgcagccattttttttccagaactctttcccttgatgacactgttttctccacagtcatcttaaatggagcctgctcatttgccgataattcctcaatcttaagctagcttctggtgccagaatgttgttcaacaactttccttttcccttattctttgacgtgcatgctatcagttattatgtctattcctttcattggcacagacctatctttaggttacttgctctcattctatgagacctctggaacctagcttagtcttctgtgctcctctgactccttgcatcatcccagaccatgccagtagcctccctgatgcatcatcagatgtcacagcatgatatttccttgccctacgataatatgacctccattttcactctgcttcagcaacctcttcatatggggggcacacttattaatcatgtcaccatctggaactgttctacttctgatacttaaactctgaaattcagctttttgactaaaacctccagcctttcacatctcctgttccctgactttcacagaacctctttgacatcatcatcacttccagttccttcccctttctcccaggaagttttctagccttctcctgcttctatgttctttcccacccagcaagcatttctaacccccacttgaccctgccaaccatttgatattaattcccacagtatcctcaattccctcatgtccctcttgttccactgcacctgccctgccaatctccagacctagatggacttcagcatctgtttttttctgttctgttcccaggctgctgagtaagtactagggaaaattgtctcaccatgctgattatatccatgaccaaactgtgatttctaaccacagctggatcctcaacggctgttcactaatccttttttacacattcctggttggtttattttccaaattcccacagcaactgttccattttcttaccacacccctcaggcctcctaacttagtcctctctatccccagcttcccctcagcaggtaatctattatatagattacctgctgaggggagctggagaaaagagagagcccattggtcacaaactttctctttcccatccaaacatttatttccatgggtactttcatcttcattcttttaatatcatcttttccaaggctaacctcattttcctttttacctatcccctgatgcatcttttaagatattctgttccattaatcatctcccttctctctcttgtatcttcagtgtttttcttaaagagctttttattctgcctgcagacatatccaagaatccccctttcatttcctaccccaaaatcttctttttaatcatactatccccataggctaatgggatatctttttctcatactttatttcaaagtatgttaaaagagccatctatacttccttatctttcagtcttcagctcttgaaatctggcttctgtacccttccctctactaaaaactgacctctcacaggtcagcatgacttccagattcagattaggtgggattatgtgtcccaagacacgcaaaacagaggagggaagacgtgtgtgtccacgcacaccaggttgcccatgcctgtttagatgagaaaagaagtatgaagcaggaggaacagagttcgatgctacatctttcttctattccagggtggttcatagtgtgatccagtaacacattacttctttctctgcttttattattgacaaatgtttttaccttctggtttgttaaattccataaggaagtgctacctttttattacagatgagatgatgatgatgatgatagtggccacctactgtgtgacatacactgtgatagatatttaaatacattctaaactttaatcttcattaacagcttagtgaagtaagtattttaatacccaattgatccatgggccacttaaggttcagagagggcaaatgtcttgaccaagatcacatgacaagtaagaggcaacacagagggttgaaccctggtcagcctggctggaaagcaccttccttaactattacactattgccttctataatcgagtgccagatgccatctcaccagctcttgatgatcataactgtgagattatttttgctttttgctgtttcaagcatcctaataactttgttaccagtcgtactaaatcggtatgtagactcctctagccctaggtatgatttctggcttttttgccttgttttctcttgagaagcagtgaatatcccttccaatatggtttttctttgtcacagttggtggtattttttccttctcttgacatttccctttcagtccatatttatcatgttagtgaatctccagcgaaatcatttcttcctgctctttgtgaaattttctccatccctggccagaagtccatcattctgagattttaagtgattctccagaaaaactacatcctattatttgacatcatctaagtagcaagatattcatttctcatatcttctctcctagtgaaaagtcatgaccttcaacaggaagaagcagtgaaaagcttccatgtgccctttaagtcttcagttttctacctaagctttcaaagtcagtagagatacagtacaggtccctcttggttatataatttgttcccagatctaaacatttgcatgaataaaaataaactaaaagatgcataacatccatgtctattttattgaaagagtcaaaaaggtacatgacataaggatccaagtgggactgataaataaaaaggcagcttctgctgttaatggggctgagacaattgcaaggttaacaggaaacaccgcttctcccaacgtcacacagcagctggaaaatgccatgaagacaccctctttcaatggctactgctttcttatcaatgatgcttcaagacccacttggctcttcccatgtattactggagattcccaattgctgagctgcaattgcccatagcagcggcgaatccctaatttattcctgcttctcctgttcctgcctcataaatcataaccagtccagaactgatccctgcatttcttaggccttcctcagaatccttcaccaggaacccacaagaagctttttcccccttcttgttgagcacattccatgaatcctctggagtgttgtccttatgaaagagtgaacagatcggactttatcagactacaggcttgtccttggtggtctttagttgattaggctttaaatgtcattctcaccttgagcttccctcaaatgaaaatttgaactatttaatttcaagcctggcccggtcccatcttttctgccatgaaaatgaaagcccccacactcttcttggctcagtccaggtatagtgctaataacagactgatctggtgccatcttaagcctaggggccgtagcatgagctaacaatccagtattagaatgataatagggaattgacatacctgggtcagtcctatacatggtggtaaaaggggtacagacttaatgagcagccagtgactccagaaggagctgagaggtgaaagaagtgagagacataaattggcttgaaacatatttttaaggaagtgcttgaattgaggtaggtaagaacaagtgactctgggcagattaggatgacttgtgtaaaaggatgggtgcgagaatgaacaagtcatgttaaaacaagagcccttcctttgagactggagaggcgaagaggaagaaattttacatttgttctctcttttttgggaagtatgtggtttaagggccagggagaagctgattaggatttcagaagatactattaaaacaggtggccatcatagtaatggaaaactagtctagtctagaaaagaggaggaacagatatatctagcagtatccaggacagggtggtaaccatatataacttatagcatgctctatgctgaaaaaccccaatccatatgtgtgtacatatgtgtacataaaccaggcagcttcttttgaaggtactttacttgttatctggagagaagatgtttttaacttctgctcaccttgaccactcagagcaagaagatatttcctccttcttaattctggccttacatttggaaaaagggaatttgatttccatccttagaaggccatctcaggacaaatattacaaatcagccttccctgcaaaagagggacaaccagtgaattccgtgtcagagttattctgaagacctgtgctgttttctagtgaggccatttaggatatagtaagtatatgttcttcctgtttgtggaccaggtttaagtctgtctttttttcttgttatcactaagaagagctaaggaatgcctgcatcatcattttgacagaaaccaaaactttaattctgctgtttttgaagtaaactagcacctttcttatcttgggcaaattcattgaagcttgttaaccagttaggtggtaactctacctctttattccctatttggatgtaatgcatgttgcatttttaactctgactatataaataacaatattaagtatggtacagttgctttggcctggaaggatgtttgtccagcaaccatttattgagcaccaacaatgtgccagaaaatgtcaaacgatgtcgagaaaaattgagctgcttttgttcaaatcaaagcagtaaactacttctaagatatgttcttcagaaatagttgtcacaggagcagtaggtaagagattactttttgtaaagaaacttcatgaattctatccaattgtaagtaaagtcactgcatgttagtgaaaagtgtagcttgaaatagatttttgtcagttacagctgtaatgaacaagtagcaatttaattatttatattttacttaaataggatgaactgtgtgccaggctttattctacgcaccttacaaatattaactcataaatcctcacaaccaccttatgaggtggatactgttttcaccccattgtatagatgaagaaactgagtcacacagagatttagtgtcttgcccaggattatgtggctattaagttgtgatgttaggatttgaatggactctatttccacaatctgtgggatctatactaagctgcaaataggttcttactgagtggcccataaagttaattaagtggatttatcatgccctctgaagtcttgtttatgctattaatctgtttatcaaactcatttatccctatataaagatctttttctacccagctataatcaagattatgacaaattctgaattctatttattttttttatatattattttaagctaattttttagagcacttactatgtaccaggcacttgtctccaaggctcattctttcggccatcacactgttcagttccacaagccctctcttttccattgctccctcaacagcagaatcctacagaccgcacataggatacctttattctgcctcaatttgttagtgaccaagtctccaaagttcaggggaaaacctttcttgaactatatcagtatgtacaatgactgaaaattgtgtcatgtacaacaaaatatatgtactctctagggcacccagcaggattgaaataagtcagtcaacagttttgtatagctcattccatttggaaggtgaacagatggtgtcacttcagcttactcctcctcagcttaaaatcaggagcatcagagtaacaaaggggctgaaggtgggtctgatgatttgtgagattctgttccaccttgagaacatgtgatttttatcaattttttcagctctattgagatataattatatacaatataccaagatatctttatgtaggttgtattccatttatctcagcaatattttgtagttttcagtgtacatacaggtcttgcatatcttctctgagatttatccctaagtatttcatggttttgatgctatttaaaatggtattttttatttcaatttttgattgttgctagtatatagaaatagaattcattttttacattaaccttatattttgcaatgtgctaaactcacttatcaattttagtaatggtttttgcaggtttaatacatagatgagcatgtctcctgttaatacgagatttaggtgctcctttccaatctggatgcttttatttctttgtcttgcctaatcccactggctagaacctccgatataatgttgaaaagaagttgtgagaaccttgccttgttcctgattttagagggaaagcatccagtctttcatcttcaagaatgatatttgctgaaggttttttttgtagttgccctttatccgctggaggaagttcccttcaattcctagtttactgagaggtattttaaaattagaaacaaatgttagattttctcaaatggtttttctctatctattgtggtgatcatatggtttaatagtcttttaatatggctaattacattggttttcaaatgttaaatcaaccttgccttcctgagatgaaccccactgggtcttgattatcggctttatatattgttggatttgctaaaattctgttaaaaatgtttacatgtatgtttattagtgatattggacttcagtttttttttctcaagacatctttgcctggttttggtatcagaataatattggtctcatagaatgggtggagaacaactctgtcactagaactagtattatttcttccttcaatgtttggtagaattctagtgaagccatctggacttggagttttatttaggggaatgtttttaactacaaattcaattttttaatagatgtagtatattcaagatatctacttcttcagtatactttggtaatttgtgtgtttcacataatttgtccatttcatctatgttttaaaatttgtgataaaattcttcatggtattttcttacatgtttaaaatttgtagaatctgtagagatgtcccctctcattcctgatagtgataacttgtgttgtctctcttttcagtctgttctgtctggttaggggttgataaattttatggatcttctcaaagaactagctaagcatttccttgatttttctttcatttttatgtttcctttttaaatgttttctatctcattgatttttatatctctgatctttttttttttttttttttttttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagaccacatgattgtttatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgggtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaaatttacagattcaatgccatccccatcaagctaccaatgactttcttcacagaattggaaaaaactactttaaagttcatatggaaccaaaaaagagcccgcattgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttaaacctaaaaccataaaaaccctagaagaaaacctaggcattaccattcaggacataggcgtgggcaaggacttcatgtccaaaacaccaaaagcaatggcaacaaaagacaaaattgacaaatgggatctaattaaactaaagagcttctgcacagcaaaagaaactaccatcagagtgaacaggcaacctacaacatgggagaaaatttttgcaacctactcatctgacaaagggctaatatccagaatctacaatgaactcaaacaaatatctctgatctttaatattttatttttttttcttactttgggtttattttgcttttcatctcttaaatttcttcaggtgcaagctgaggcattgatttgaaacctttctttctttctttctttttttttttgagacaaagtcttgctctgttgcccaggttggagtgcagtggcatgatctcagctcactgcaacctccgcctcccaggttcaagcaattctcgtgcttcagcctcccaagtagctgggattacaggtgcatgccaccacatccaactaatttttgtacttttagtagagacagggttttgccatgttggccaggctggtctcgaactcctgaccgcaggtgatctgcctgcctcagcctcccaaagtgctaggattacaggcatgagcccctgcacttggcctgagacctttcttcttttcaataatggtgtaaatttcccttcaagtcctgcttaagtagcatccctatttttgatatggtatgttttcattttctttcaatgcaaaatagtttctaattttccttttgattacttctttgattcatgggttattaagaagcatgttaatggcttccaaatatttagtggcttttgcagctatctttctgttactggtttatttaatttcattgagtttcacctgagaacagactatgtatagtttgggttcttttaaattcgttcagacttgttttatggcccagaatatggtatatcttagtaaactgttctgtgtgcacttgaaagtaacgtggcttctgctgttgttgggtggtgtgttctaaaaatgtcagtagggtcaaattgtttgccagtattttttaaagtcttctatatcctgattttcttctatcaattattgagagagtggtgttgaaatctgtctgtgattatggatttatctatttctgcttgtagttctgtttttgcttcacatatttgaagcttggttgttaggtgcatgcatgtttaggattactatgtacttttgatgaattgctccttctaatatcatgaaatgaccttttttattcatggtaacagtctttggtctaaaatcttctttctctgatgttataaagacatttcagctttcttttgattggtgttagtgtgctatatcctttcctagctttttacttttaacctatttatatcattatatttaaatcaggtgttttgtaggcaacatgtagttagtaggttcttgttttctaaatctagtctacaaatttctgctattaattggttttttacaccatttatacttcaaagcagctttatttagatataatttgcataccatacaattcacccatttaaagtgtacaatttaatggtttttattatatttagagttgggcaaccatcaccacaatctaatttaaaaacatttctatcacctcgaaacactatgcccattagtagtcaatccctactccccctacccgcacctgagcactctaccaccactaatctacttcttatctctgtggatttgcctgttctggaaatttcttataaatgaaatcatacagtatgtggtctccgcataatttttttcaaagttcatctatgttgtagcaggtagcaaacagtacttcattacttcatttgttttatagctgaataatattcctctgtgtggatatatgctacatttaagaaaatccattcatcagttgatggatatctgggttgcttccactttttggctattacaaataatgctactatgaacattcacacatatgtttttgggtggacatatattttcatttctcttggctatatacctaggactggaatttctgggtcatatgataactctgtgtttagtattttgagaaactgccaaactgctttctaaagcagctgcagcattttacatttccaccagcaatgcgtgaaggttccagtttctctgtgtccttgccaacacttgttattgtctgtcatgagatatctttccattgatttaggtctttaatttcttttaacagtgttctggagtttttgcagtacatattttgtacttctgttaaatttattgctaagtatgatactattttggtggtattatttataaacgcaattgttttcttaacataattttagattattcattcctagtatataaaaatgcatggattttttggtatactgaccttgtatcctccaaccttgctgaacttatttattagttctggtagttttttggtgaatgccttaggaatatatatatatataaatatatatttatttacatatatatttatatatatttttatatatattatttatatatatttatatatatatataatcatgttatatatatttagaaatagtttcacttactttccaatctggatgccttttctttctttttcctgtccaattaccgtggctggaacaatattgaatagaaggtgtgagattgtacactttgtcttgttcctgattttaggtggaaagcattcaatttttcaccattaattattatgttagctctgggtttttcagagacggtctttaatcagtttgaagaagttctcttctattcctactttactgagtgattttatcatgaaaggatattgcagcctctgccctgggagtgaactgggatgagggtgatcaggacccagtgtccttggcctgctgcacctggagtggagacttagcgggaggagctcccattttcttggctacccatggaggagcctctgtaacccagagctggggaaagtggtaaggaagtagttcaatgctcagataccacctgctctactgttcgtgctaagatttagcagattttgttgaatgtatgtttgctgtatgcccttaggataatttccagaaactttaaatgattgctttaacaagtattttttgccagttaaattgttgctttacgagggagagaatctgccaggttccttactcttccattctggaactctcagtcaattattaggactaatttttaagaatgtatttggaaataatttcaaacttataaaaaatttgcccaaaaaagtacaaagaacactcttacaccctttactcagatttcagatttacctgtttttagcattttaccctatttgctttatcatatgcattctctggtgtgtgtgtgtgtgtgtgtgtgtgtgtgtgtgtgtgtgtgtgtgtacatatttctgagacacttggggataaaggtacatacctcatggccctttacccccaaataattgagtatgtatttattgggaatagagacattctcttacacaactatagtacagttatcaatttcagtaaatttaacattgattatcttctctaccatagaaattctaatcttcaaattatttttatccttcctccctctgtttttgtgtaagttttatattgtacgtaatattagtacaatggtacatacatgggagtaaatgttgaaatgtttttctactgacagacatgtgcgataaaaagttatgaagcaaccggtccagaggttgacaaaatgctttcgctgtatcagctcagctgatcctgccatcacctcatgacacaggcaagagttattttccctactcatatcacatatgaagaaacactaaggaatttactaaagatataaagctttgattaacaagtgttggatatgggcctcaaccccaggatttttgaccccagagtctgtactctttccataccaaattaccttgctgagtaagctctcagctgtctacatgtgacttttctactttatgagttttaaggcaatttaagatcatataattctaaaaattgtgccagatgcttccaacatacagaattgaagacatcgtggttcagtgaggttaagtgatcatcatttttaaaccctcccttaagcaaagtaggaaaaaggaaaccttactgtcatttctcttccttcactcaaaatcataacccccatacatcctcagaaatgtttgacttgtctgcttagcaacctttatatggtgctttactgattacagtgcattgtaattcattctttcattttagagccacaataacctggtgaaaacaagaccccaaggtaatgaatatgcactaaagttggcgaagcactcctctagagcacctcctcttcacttctgcacaaacctggctctgattgtcccctcacccatctctctggcaatgctcatgaattcttgtcatggctagtgtcagagagactttataccagatgatttttctgtggttgaaatcagcagtcttcagggtggaatatacaagataatggaatataggaagaaaataattagtattttttgccatttctctgttttttattctctgtatctttcttttttttagttttaatgtattttttaaaaattttattattattgtactttaagttttagggtacatgtgcacaacgtgcaggtttgttacatatgtatacatgtgccatgttggtgtgctgcacccattaactcgtcatttagcatatctcctaatgctatccctccccactccccccaccccacaacagtccctggtatctttctttcttaacagctttattgagatataattcacgtattatacaacccacccatttaaagtgtacaattcaatgatcttaagtatacagatggtccctgacctatgatggctcaacttacttttttttttttgactttatgatggtgtgaaagcagtagcaatcagtagaaacagtactcttcttgcagtgctggctggtggcagccaggtgcagctcctagtcagccatgcatttttaacttacgatattgtcagcttactatgggtttgttgggaatgtaaccccatcataagttgaggagcatctgattcacactaatttcagaacatttgtatcttaccaaaaataaactcccttcccatcagtagtcaccccccagccttgccaaccatcagtttactttctctttctatagatttgactattttggatatttcatacaaatggaatcataaaccatgtgttcttttgtgtctcacttctttcactgagcatagcatcttcatggttcatctatgtcatagcatgtatcggtacttcattcctttttattgcctaataatattccattgtatggatagacagcattttgtttatccattcaccagttgatggacatttgtgtttccactcttttgctattatttgatatgaacatttgtgtacgagtcttttggtggacatatgctttcatttctcttgggtagaactatgttcctagattagtataaatgccatgtgttaaattttgagagaaaaacaatagaaaagtaagtgtggctcttggaggggatggaatttttcaccttccatgttattcctctcactctgctccattttattgaccttcctatttagctctttactggcctttttttttttgcctattttcctgtccacttcttactcctgccagggatgctctggggaaaggaaacatttattgactaatattgaagtgcacatttagctctgtaacaaccttatgaggttggtgctatgaaacccatttaaagatgaggaaaataaggctctgagagtgtaactaacttattcaaagtcacccagcccttaagaggcagaagtgagataagcccatctctatctgattccaaagctctttccataggctgtctcccagatgaagtgcttattgaagttcagaggacataccttgcttctcacttgagacatcaaagatggaggtgtgaagggagaaaacgaagtgaaagatgatgccaagattttgatgagcctgtaggagtgggttgtgcaagaggtggaaggatggtaggtaccataactgagatactgaatacaaagttagaacctggtttggggaaggaaggagttggtgagtgttcagttttggacaaatggaatttgaggacataattcattcagctgatatttcattggcttctttatacaaggcacagtacaggatgctggagatacactgaagaacaagatagccatggtcactaccctaatggaacctgtggtcttagtaaggcagagagacaaaacaatggtaatcaagtgtaatgggtgccatgataggagaggaggaggatttaacccattaccagagtttgcaatttttttaaatttttgcatgggtgaaaaatcagaccttggcaatgaccttgagtagtaggatataaataactcctacatccttagcgttccaataatggaacactaggcataaatgggttaattgaagcatctagtgaaagtgattctttaagggtctgaggctagtagaaagaaaatcaaagtagccatagcttacagtacaggtgggacatagaattaccagagatggatataggagataaaaagatttaaaagtcattcataggaaagtaaagagttgataatatttttttcctccatttaccctcttcctataagggaggaaaataggattgcctgcagccacatggaacagctggcagttttctgactctcatcctcttatcatctttgcatatgccctgccctcttcctggagttctgatctcccatcccttttgtctagccaactccttcctatctttattatcatttttcagaaagcttaccatgaccccctgttccatgtccccatagtctcttgggcctacttgatcacacggtctcatctattaattgtgagtattctaagagttgggacgtgttcatcaatccaagtatccccacagtgcctgacacatagtgagatggatgtatgagtgattaaacaaaaaggaccaaataatgagaaagacctgcatcctttgaacaagtggaagaggcttcatcgcttcatggaaagagagcttggtcattagtctaacttggtggttcttaaccagtggtgattttgcttttccaaagaacccttgataatgtctggagatgttgttcattgtcaaaattggctagggtatctactggcatctagtgggtggaggcccaaggatgacactaaccatcctacagtgcacaggacagccccccacaacaaagttagtagtgtcgaggtcctagaaatcctggcctaatcttgcttagctctctcttacctaaagcagttattctcaaagtgtggcccccagccgtggcagcattacctgggaattgttaggaaaattctagggtcctacccccaaatccctgaaggagaaactctgggaatggggcccaacactttattttaacaaaccctccaggggattatgatgcaggttaaagtttgagaactgctcctaaagtgaaaaatctggttggtaacaaggccagcaccagaactctgagaggagccagcacagaaatggttgagggataatgtcagaaaaaatccacaggaggtgatggtttccagggtgaagggatcattggtatcaaatactgctagatatgagaacaggcaaagatgggggagactgccactaatagttaagactcctgaaatggaaggaggtaaggatgatgttgttacaaagtgatgggtttgtgcaaggagggggtgctgaaagcttttaatttgtactcatctatgcaaaagaactgcttttaaaatttctatttaatgtcaggcatgtgggaatagcatgccaggactatcatccctctaaaacagcagctctcattatttttgtgttttcttccaggctttgtctatgtacataactatttttacagtggagtgttctgctgtcacaataaataccaaggcgttttcaaaggttacgacagcaggagacagcattttgacatggcagcaaagataaacttgatcccattgtaagtttgttctgcttgaggggagggttgtttggtggaatttctaggaaaagcaaggcagatgcacttaggctaattttggttacttgagaagaaagcaataaaaacccctccggtacagaaatgtttcttaagcctcattaaggaagcaaggacacagataagacaatgtggaagaaaaggtctcttttagcggaataagcttgcatcataaatagtagatatccaaagtggtatctcagagccaccctgtggttcccagattttatttggattgttcctttgggttggattatttgctaaagaagctgtttattgagtggagttgaagagcagggagggattttagagtgtatctattttgagggagggggaattgaaacaggcgctgaggttagggatttgtttcccttataaaatgaatatattagggcagtgctccctaacattgaatataccctttaaaaaagttattgtgcataggggactttttctcagtcttttcaaaatttgtgaatatatatgtgtcaagcacagtgcacacttcacagcccagggaaatcgatggtgtatatgcaatttataaatgaggaaattgaggctcaaagaagtgaaacaatgtggccaaagtctgacatcaaataagtgtctggaggggaattctaaaccctggtatgtttccctccaaatctagtgtaatttccacagtgacacagttgccatatgttgtcacattcttagaggtatctgagactccttcatttctcttatcagactaatatgtagtcattacccaaggttgtatatgaggaccataaggggactttttcgaaatatctgtgttcagactcctcccatagaggacctctggagtgagaaaaagaataaaagagcactcaccctctcatctcctagtgtcttttctttcccccctccagaagcccaggctgtacacaggccgattttagagttgtagagcaggtggtgggcagggctgggctagccagcagcagcaagccgattcagctgtgatggtgacagctgctcctacccagctgcccataactagctgatctcaatcacctgggagagagacagggcgcaaaagggtcttttgtggccacaggcaaactggagtcaagctgcctgcgttcagattttatctctgttgcaaaccaacggtatgaccttgggtaagcggatcccttaaattccccaggaggcagaataaagtagtgagtacaggtaaggacgctgagatctgagggaagtaggtttaagctccagctctaccacatttactaatgatatacccagggtggacttcatgggcatgcaacctgtgcagtctcacagggctgggcacttggaagggcctgtgtgtgcagggtttaatcctctgctctcgctgtcttgaaattcttaatagtttttgagtaagggaccttacagtttcattttgcactgggccccacagattatgtagcttgtcccatactgcctttgggaaattacttaactgctctgagtcagtttcctcaaccattgaatggcgattgtcctgagacttatatgagaggatgcatgtaaagcacttgcttggcacagagcatgggctcagtagccagcattaacacagccctgggcatcagtgtcttcatctataaaaataaaagtgttatattagagcatgtctaagatttcttctacaaatacaatgtacttacaagatttccttgaccctaaccaataggaaaacactttggaaaacataatgtaaggcttcatttcctttcttatacagttttgatttttttaaaaaacatgtccatgttaattgtctctcttgtagctgctgcctgctagtcttaaaatctctttttgaaaattcttacagaatgattttaacctctaacctattttaagtgtgccttttatttagtgaatgtaatgttgagagagggtaggtttggcctgtaaactctcccaagagggtggactttttaaaaaccaatgtggaagataaagttaggaacaaagtatgtgtggaagggtgggggattgccggaggggatagcatgattaaaggggtgttgtggtcttgttttaaatacatcactggagatgtagaggtctggtggggacagttgaagcacaacctccacaaaggtgaggaagaagataatcaaaacacaggatgggggccaactttggagaggataaagggaatgtcatcctctgaaataagcaaaaatagcttgaagataccatgattttttaattgtatgctgaaataccttaaaagaaagaagggaataccttccctacaaagtacctactatttatacaactctgtaatctctttgtatccttgttgtttttaccaaaaaagatgtttcttttctccctttattttagtaaagtcttgcttatagcccacctctcccacactccccaccatatgacacacattgatcatttttcacttttgatggctagagtttagtccttcacaaatacaccagagtttatttgatcactgatcaatgagaaaacatttgagaaaaagatgatttgtttgaaagaatgaacttgtctataagtctcgtatattgctcatttctgtgtatcacagggtagttctgaagctttttacctgctttgaataatttctgtccattcttcctacttaacaaaatataattcattttctgacagccaactcaatttgtttgtcagtgtcttcctggaatttaaaattttcctccaatattaggtaaactttcaggtgattcattttaaatgagaaataaaaattatatatatttatcatgtattacatgatgctttgaaaggtatacattatggaatggctaaatcaagctaactaacatatgtatcacttcacatgtattacatgatgctttgaaaggtgtacattatggaatggctaaatcaagctaactaacatatgtatcacttcacatatgcttttttgtgatgagaacattcaccattattgtacaatagattcttgaacctgtttcccctatctaactgaaattttgtatcctttgaccaacatgatttaaaaaaaaaattctgctgccttgctggctttaccttaagctctgctttctctgctttattttttctataattcctgcatattgaagcaactttacttttataaatactaactaatcatattaaaaatctagtactgtctaatgtatttagggttaaagatataaatatacctatgattattggaatgctgaattatatgtctatatatgtctcccttaattttacactacagtgttaaaatagtatctaaatctaatcctacttttaggaatacctaacaaaaaattcagccattccctcaactctgttgaaagctctgtttctcactaaagcctatattggctttagtgaagcaaaataatttaaaacagcccaaaatgcttttttaaaagtatattttaaatactgtaaaataacaaggaagtatacaaaaactatttatggataaatggacttgtgattggaaacattaatatcagccaaatttccaaaagcagtttcacttaatggctgaaataaaatggagaaaaatgtatgaaaggttgcctaacaaatagattaggcataaatgactaaaaatgaatctgaaattttaaaaaaatctgaaagaaactgaactgctgaaaatatgcattgaaagttacaaagcagtcctagtggtgcatggaaatgaccagtatataaaatgccaatgactgaaaatacggagttttctctccagtatttgtttctttgaccaattcatctagagccaatagagtactgtatccttaataactggtattgcttttcaggaaaataaaatatgacataccatttagttttattaggaagctaataggtgtacagggttttcattgctgataaggctgaacattttctagtgttcctttcttgttggtgtaatgtttttatatctttaaccacttatctaggggaaagtagtattaaccataagggtgtatcagaactttattattttctatattaagttatttctccatcaaaatcatggctacttctatctatattgctttccttttaaactttttaatttttaaatgtacttttattgtactgcctctataattgcaaaatgtactttatgtagtcatattcatcacgcataggtgaccatttcattttttgctttggtattaatgaatttctctcacacattgagtgtaaatgcaacattgcattttcttacagttcttcataattaaaaaaagcttgaatccttgactcatctggaatgaattttaattgtttccccaataacatttattaaaagtttttttccccaatgagccgttatttctctacactataatccaaaaaggttatgtgaattctttttccagtgtccattctcccacacagctgaagttgcttgaatcttattctaatttctgatttcatggttaatgcattcccctgtctctgagccttacacatgtctttctttactttttaatctggaaatccaacccttatgctacaccccaaccacaaaatgatgatcaaacaaacaaaactacatgttgaaattgcatcagaaaatactatggatattttctttcatttttccatgcctcagctttagcatctcagtcttagcaggtttttaattatatttatttacttatttttaagtgaagttttaaagtattaaagtcaagtctttcaagattcagcctttaaatctaaatattactaaatttattcctttctactactagcagccagactcagcagccattgaacctttttttttttttttgagagtgaaaagcaaaagaactcagagaataatgtatttggactacaattaattgtgtataagctaaatatgaagctgaaaccaatataataaaggttctcaagattcaattcatcagactcttagtggcatcattaaggaaatcagtttaagtcttcacacccagtgtacttttgcctctgagtcttaggactttgtaatgcttctgactagagccagtcagtctgtattggaggggatctgggggcgattatcctggctttagtggcagttactcttttcccttttactgccattatcaaccctgctcatttcgtcctctgttttgccctgctaattttatgctgttttgcaaagcagcaacagagacaaaacattgcttttaatgcaggtggcatttaggggaaaaaaaaaacagttggaagttttaagaataaacattataaaatccctttgaatgacttgaagggcccagggtagcataaatgtagaggagccttctgcccctgatgggagacttgtaatgtcttctttcaggatttctttttatattccaacaaatagcatcatataaaaccagactgaagaactctttttttttttaattcaatcaagggccactgacccgctgaaaaaaattcaattaaggttgctgagggggaaaaaagcaactgttacaaagtaaagaaatagaacttgttcaattcatctggttttaaaattaggaaaagagaacataaaccccccttttcagtaaatgcagcaagtaatttacaagaagtacttcagttttatgttattggcaattaaaagagaaacacaggagagagaaaaaagaggagtatactgagttacatacacataaaggctagccccctcttaagaggtacggctctagaatagaagcaactaaataatgccaaacgttgctattgaaagcattctaaaagatgcagtgcaagcttgtgtgcgtgtatggaaaactattttacacgtttaaaatggcaactatatatattattgtccatctcttacaaattcttgtctttctcctttgtttctgtttgtgtgtgtgtagagagaaaatattttcacattgcttttatcactgggatacggttttttgttattatagacttttccaactaatgttattttgtacattcatttccatgtattagtgtgctacaaatacttattttaatagctaaattaaataatatcacatagattccttgagatcagagactggatgtttttcccccagcattattgtggtataactggtatacaaaagactgcacgtaattaacattacaatttggtgcagagactgcatgttttgttcacgtgcatatcactcaaaacaaatgatcagtgagtgaggagaataaatgctacatcagagttggttcaatcacatctctgggattttaaaaataaatcatgaatacagctgtgaggaacatcttttgtacaagatggaagatgagaggtctatttggggggacaactgttctctgaactgggagtattagctcagaacaatacagttggtatatgctgtagtataaacagtttgagtatcttcattatccacatagccccacagttatttggttttctctttatttttttactaacacgatgagtgaatatggtacttcatactcatttacttgtgcttcattttattcattccttttatacaaaccatctgcttctaacctcttgttctgaggaactggcattaactttgtatttagatgggaagctttttgtgtgtcatattgtcatactacagaggtaacattgacaggattcagcaagtgtccaggtggaaaggaaggcctaacctgttgtcctctttgccatgcttagtctccacagtgtatatgtatacagggtaaaatatatatgagatatattaaaatatattaatatacataatgtattataaaataatataaaatatattaatatacataatataatatatattaaaaatataaaactttggtggttgctgctgtggtaaaagggatttctgcccttctaattgtattcagtagatatttattgttggagtgggaatgcaatagatttttgtggttttataatttgcgcctttgttgaactcattatttttaactttgtttatcaaacatcttggccttttaggttatgtaattacttatatattgtgcaaatggtgttgtttttattttatcttcttacattactcatttatttttcctacttgcttacaatggtcaacattttctaacacagttaattaggaatgatgattggatatctttttggggtttttcttctttattttagatgactacttctaatgtgtctctcttaataacattgacttctttcagacatatcatatttgtgataataaaaaatcctacttttaaaattagaaacaaatgttgaatttttagattttttaccctatttattcacttaattgtgtttttactgtttttcttatgaattgtctttatttaaaatcagccatgcaacctcagactaaaatccaactgatcatgacaaacaattcttttaaagtgttgatgtatagcttgctaatattgtatttagaattttgcatcaatgtccagaaataggaacaatctataattttccttgtgagattttagccatagatcaggtttagtaatcaagctgaccttagtttcatgaaaataagtttgatagaacacttttaggaaccatttgtactgtaagattattatttatttaatatttgaactgcttgtgtcttttttgtttcttttgaagtttgttgataatattgcttatttcttttctttctttctttctctctctttctctttcgttccttctcttcttttcttttttgtttttttcttttatttctacagggtctcactctgttgcccaaagtggagtgtggtgggcagtgacataatcataactcgctgtagtctcaaacgttggggctcaagtgatcctcctacctcagcctcctgagcagctaggacaataggcatgcaccaccacactcaactatttaaaaaatttttttttgtagagacgggatctcactatgttgcccaggctggtttcaaactcttgggctcgaatatcctcacaccttgacttcccaaagtgctgggattagaggggtgagccaccgtgcctggcaatattgcttatttctttggtatatttagattctttctctcattttgagtacttgggctgttttttttttgctgttgttgtttgagaaacttactcctttttgtgatttgtggcatatttacatatggaattccctaatgatttaaatagttttttagtaagtataactaaaatatatctttaaggtgaataatttgtctacttttctcctttatttaattgtactggcagtttatcaattttattcgttttttcaaacttcttaatacaggcgtgtagagctatggatacattttgattccttgattgtattttaattagttctttattcagttgccatttaagaaagatatttttatgatttctatgtggttggattgtgttcttatatcccatttcctatcttactgtcttgtgctgtgtagaaatcctgccatttcatattgagaatgtctttgtgtttgactatatgacaaattattgtgagaaagaacattttcccaaatatttttacatgaatcaaatcatataaacctgatgattatattgtattgtctggtttagatatactgaattctttcattgttgtttttgttgctaatttgattcctcattcagctaatggaataatctctaggattgtgtttgtctctgtcgtattgaattgatcagttttttgttttataaaaaatcattagatctttaaaaatttactggatatttaaaaaatcacttcctgtttcctttatcattttatagtgtccttgtgctttggtttaagatgtactttttttcagattctgtgactaatatcttgctctttttatttgcattaacaaacttaaagggagtaaccatttaattaattaatttgtttacttttcaaatacctagagttcaaagagagagtaaccattttaaacatgtatttttataactagagtcagattttattaatccaatttctaattaatatttaatacataaaatttagcattataattatcttacatttttaacttagcagtgaacttttctttttaaattcatactctagtaaatttgagggatgatttaatgatatgaaaagataaccttaatttcttaatttatcttgtggctttgattccttttagtgctgtgtgcaacactttcttttatttgtaataatgtattggttatttgccatagaactgtagtctttcttaggtagttgttaggccgtccatcttattctatttgtttttcttgtggtctttcctatgttatcttaattgatgctctcttcaccctatcatggtgactttgcttatctacttctagtattgtaaagcttttaaaattggacctggcttacttcttaaacaattacagtaattgagtcctatcgtgattattttttattaataatccttgttattcttccagattttaaaaaatggtgtatttaatttcaaaggcgccatctgcccagatgtctggcttcttgtactacttttttaagtcattttctttatttagtaacaattaacatgttttaaaaacgcctacatgaaattttctttcagtgacatgaaaataaattgttttttccttagctgaacgtatataaagatttatttgtctaagtttctaaaatcttttgggtctttcaatctttatgttagcagatatgatatttagcacattcataagttgtataactttcagatgattaagagtttcctttgtatgtatggcttaattttccatcatttctcatttttaatatacaaaaaatgtcagttattgaagaaaattcttaggaatctaccttcctctttccactagtagattatttccaaaatgatgagttaaatgaaaaaattaatgtttctttactgtgggacttctcatggcttttaatccatttgtatgtttccccaattttttcttgatcatgggacaatcatacttcattttttaaggaacacatagaaacctcttatagaaccaagtgttacataattcacagtttagaaaatgctggtgtaaggtatatatacttgcttttatttagaagaggctgctgaacttgataatcttcaaaaacagaagattatgtaataaggaaaaatgcatggcatgttcaggaacagttaacgcaggtgtagaataagccaaaagcccaaagcatcagaatgctgatgagggaattagcttatattgcccaacacattttttgaaatgacatattcttattctcataggtactcccatcccaccttatattcctaaaatatttcattggccaaagtccattgacatcacctgtttattgaaatttctagaagtatgacctctttttaggagactgcagccacatagttttttgctatcttctaaacttgtccaaagttgttggtagtccccccacctttaggtcaagataacccctttggagagtaagcagtacatttctcatagaaggtggatggtatcttatccagtaagaccatctctcaatcagatttggggagaagtttatctgtatgttcttttagaaaattactaatagcaacacacttgtataaaaagtctattaaatactgcttattaaatccctaagaatcaacctctgacaggtacaagtatggcaagggggaaaaaccatattccttcctataagatacccttggaagtacttatgtgccacaaactgaatgttcacagaccactggtgttgtaattgtcaactttatatgatggtgttttcaaggcataataaaacattcttcctggaagtcccctaaacagagggggcatcttaattaggctctattaaatcttgggtaacatttctgttgcctgtgcctgtgaaagggaagcccagggaagcattgctgtttagacctttacagaatggccctcccctcaaccatggtcctgtgcaagcggctattttaatatgctcactacagtgcaaaggaatcccagggtagaaatgtgatagattcatttgcagattatacagacttgagttttggcatttaaagtgatgcttttacaccctttcctgctttctatggttatacccctaggccccctgacactgccgaaaaactcctccatcctccaaataattcagtgttttgagtcccctgcattcctcagtagtctgtcttttcttgtcattctctgtcaaggcttaagtttctcttttagagaagcaaggcctttttatgtctggcctccagcaagaaacctcagagtcctgtttttccttttttacccccagaaagttagcgtatctaagctttgccccttgttctccagtgctatattgtccatcacccaggccaggggtgattccggttcagcctcctcaccactatttccaagttactctaatccctttagttcctgagagattgttctcccttccaatcaaacgcaagaaactgctgccagactctgccctataaaataactgcattctttatgtgacttccttatttatgaacctagggtgactttccagtgcttattggctccagtataaattcttctgtgtgcttggatttcaagtccttggtaatcttgcctcacctcatttatccgtccttacctcccccggctctctatacacaccctagcccctcgaatgacagtaccaccactctttctcaaggcagctgtgctgaaagacctgctcttttaattttttttaacttgtaaactgtcatagacagatacttttgcaaagtacaataaaaatcattagaagaagaaaattataaagccatataaaatataagcttcatttttattagattaatgaacataaaattactctgtcaaattggtataaaagtccctaaatgcttattagtttcctttcttatctctgtaaacactgataatatggagtgtgggggctggcacctgtccttgtgccatactaggagtagcacagctttgccgcctgttcgttcacactgccttgccttttgcttggactctccctgtcctagcttggaatgccctgtctttttcagcaacctcacctgcccatgctagagagccccaggtgggttcacgctgcaactatacaaggctatacttaatagaccccttccttgaactcctgctgctctacttacacttaatatcatacctctttttttttttttttggagacaggttctctctctgtcgcccaggctggagtgcagtggcatgatcgtggctcactgcagcctggaactcctgggctcaagcagtcctcctgccttggcctcctgagaagctgggaccacaggtgtgcaccaccacatgtggctaatttttttaaaaacatgttcgtagggacggggcctccctatgttgcccaggctcatatttttatttttctataattgttccatctctgttagtcctacccactcaatgcctttgcaagtagcctgagatactaaagggtataaagtgtgtgtccttcccacaaaaaacgtattatatcctagcacctagccttttaagtcccttgatacatattcgttaaatgaataaatgaatcttctatccaaataaaaatatgtttctctcctccaaaagatgtgtcttctataatacatagtaggcacttcattaaaacatttatttaaaaagtatattaagttgattggttatagtttgggaacatacagagcacctactttccaacattgccctgtgacataaccttttggctactgtatggtgctgactatggcacaggttttggtttagtgcctttcatagtcatttttctgcttattcagaccagttattgccggatctgattttatggttccatggagtgtcacatgttgagaatgtgaaactttaaaaattgttttctgtttaccccaatttccattaacattcatattcacatgccatgcaatgtttttttctctttagaggttagaggaacctttaagagagtattacagttgcccaaaatttggaaattgctgaattaacctgtttcaggttaagtggttcagtctgcacactccttgatcaatgaatcatttctccgttatgtacttagtttcagggtcggtaattaataagcagtggcatttccatctcaaccagtgagtttattccaaattcctggaataagcatttgtatggcaaggtgggtattttcccctttcatttatttatttatttataattgtttttcaatagttttgggggaacaggtggcatttggtaatgtggataattttttttttttaacagagtctcgctctgtcgcccaggctggagtgcagtggcacgatcttggctcactgcaacctctgcctcccgggtccaagcaattctcctggtttagcctcccaagtagctgggcttgataagttctttaatggtgatttctgagattttggtatacccatcacctgagcagtgtacactgtacccaatgtgtagtcttttatccctcactcccctcccacccttccccacaagtcaccaaagtccattgtatccttcttcttcatcttagtcttcgtcttggctctgtcacccaggccagagtgcagtgatgcattcttggctcactgcaacctccacctcccaggttcaagcaattttcctggcttggcctcccaagtagctgggcttacaggcacccgccaccacacacagctaatttttgtatttttagtagacatgagatttcaccattttggccaggctggtctcaaactccttaccttaagtgttctgcctgcctcggcctctcaaaatgctgggattacaggcatgagccaccacacccagccattatatcattcttatgcctttgcatcctcattgcttagctctcatttataagtgagactatatgatgtttggctttccattcctagtaactttacttagaataatggtctccaactccatccaagttgctgcaaatgccattatttcgttcctttttatggctgagtaatattccatggcatatatgtatatgccacattttctttatccacttgttgatggatgggcatttgggctggttccatatttttgcaattgcaaattgtactgctataacatgcgtgtgcaagtgtctttttcatataatgacttcttttcctctgggtagatactcagtagtgggattgctggatcaaatggtagatctacttttagttctttaaggaatctccatactgttttccatagtggttgtactagtttacattcccaccagcagtgtagaagtgttcccttgtcaccatatccacgccaacatctattattttttgattttttaattatggccattcttgctgaggtaagatgtatcacattgtggttttgatttgcattttcctgataattagtggtgagcattttttcatatgtttgttggccatttgtatatcttcttttgagaattgtctattcatgtccttagcccactttttgaggggattattattttttcttgatttgttcgagttctgtgcagattttgtatattagttctttgtcagatgcatagttagtgaaaattttctcccattctgtgggttgtctgtttactctgctgattatttcttttgctgtgcagaagctttttagtttaattaagtcccatctatttatctttgttctccttgcatttgcttttgggttcttggtcatgaactctttgcctaagccaatgtctagaagagtttttctggcaaggtgtttaataatgctacaagtttagccaaaggatgtcaaggggttttaaaactttcctgttaacatataacacacctacaaaacagtgtgcaaatccagttacagctccatgatttaccagaaagtgaagacacccgtgtatccaagggtggtgagaatttcactgggaactttctttcctttctttcacagccccagcgatgtcttcttaaacatatggcgttagtgggtgtgtatgttatgaagtgtaaatagtaatccatgtgcagaggtgctgctcagttgaatgaattaagcctttgacttgtctcattgtcctgagagcattgacgccatctgtctggcagcacaaattctgacaacagcccaaatctatagggtctttcagttcatttatttttttaaaaagctttccaggtgttttgaattatatttagttgtggttagtggtaaatttatgagctggctggctacatcttcttgagttgtgccatagaatctgcaaaacggtcccggggtctctctcttggggtctctccctctctttttttcttttttttttttttttgccttccaaatttcagcttggaaaaataacaaaaatgttctcagctccccattttcccaccattactgctttctttcagctttcaagggatgaattctgacatgcagtttcatgtcctaccctaggattatacacaactctcataaagtacccatggctagaaaatctgcctgttttctccttaaaagccctatgtggtttgtagggctgacattttaatcattacccctgttaaaattcccagtgactgtccaggtgcatcactggcagaatctccaaaccaaagtttaggaataaaaaggaagaagagaagaaatacttaaatattgtacttacagtttgtgttgaggaaaaaaatgcttacactgctaaagtctattgcagcttaactaacacttcgctaggacaatatgctgagtgttcggcatgttgttttctttattttttccccctagcaataatttcttaactcagtgttccattaaccttgaggcaagccaagaacttttttaggatgcttttaatgcaagtaatttacttacccatatgattaattaagggatatactgccattataaaggtttgcatatatgtagagctataatttttccttggtttataaagtagtttataaagttctgctgacccataaaaatctaactgttgcagttactgttaggcagagtacagtagggtgtgtaactggtgtgctgtcatttccttgagctaactagggagaacttgttatttggtggctgggtgatgggttaagcaatacaatagtttaagcagatttaagaatccagcaggacaagttaggaagtgagactcctgtgaacttctggcattagagggagatgtgctggccccagtggatttgggtctcttccttccttggcttgagctgtggattctaggcatttaaggtttcctccccacacccaccttctccaccaccaaggtcaacctcagagcagcatctcctaagagacctggagaggaagggtttccggttgtccttgctttttaatttaagggctttgtttaaacctgaattcaagggggaaaaagcagtttttccacatataagggaagtatctagctggattttgtgctcttttgttactaaagttctaaaattgtggacttttagtatcctgtgatatgtgtttttcatgtgctaaattccaaagccaggacaggagtagggagggggtccagagtgtcctttcgttggctcttccagattcaatgtgtaatcactagggagagaaataagagcagaggttttacagtaaataatatagtttgaatggtaatcatcatataatccaaaagcatttcttgagcaactattgtgtatctagcattgtgaaggagggtctgagtaaatttgcctgaatcctggttctgttgtgcttattattcaatgagaacacaataaagtagtgagtggcattgtcctaagggagtttaggaaagggaaaatatcatgaaagaagtgagacttgagctagcctttaaagacagttaatatttgggccagtctggcccagtaacacaagtctggttagaggtgggtgtgggggctgaccatgaggaaattggcttgacttgagaagagatctgtggggcagctgggaagcagggcaggggagttagagatggaatgtggccaaccacagggaatggccttggagagtaataacctaaggaaaaggccaggacatcagtgagaaaaatagggatagaaagtaaaggaataaatacaaaatactgcaaacaagaaagtttggacttggtaccaaattaaataccggggttaaaagaggagggagcaaaagagaatcgacattctaagtaggtgacatcaaaatagcaattgtgatagcagagaatttggggagaaagaaatctgctttggggagcagtaatgtgtttaggtatgtttttcaagtgtcaaactttttatttggtggtaatttaaaatatgctgtggcttgaatgggagagcaggaatagatttttagaatttggaagttatttgagaataatgatgtctgtaacccataatagaattcagagaaaggtgattagacagatgtatggtggggcaaggtggagtggtggtggggggctagccacaataggaaccttgaggaaggaagaagtggcaacaaatattgaaggaaggatcagagaggtagtaggagaaccagaatactgtaccatataatataagctaaaaagggcatttcaggaattagggagtcatcttatgtcagatgccaaaagaagaaattgaggagagtaggaagttaaaaatccttttagctgtattaaagtctagtatatattaagcccatttgccatgcaaagttagaatctcattataacacaacctgcaatagtacagaatttgatacactcctattcagttttgtgctctattccaagaggatagatattcctggaagcatcttatccatgactcttctgctgcataaaccctagggacagcataagatagaagtttatgcatattctcttaacagatatacagcaggtcacagcagttaaacacgattgggtgaattcttccaccaagtttcagcaggctttttacccctccaaacaaatattcatatcaactttggtatgatgcaactaagatgcagaaacattagcctctcgctcttgaggctcaactcaagtcagtgaaatggggttggaactataatccggttccccagattgtctaatttgtttttttcttctctaacccattgagaaaataaagattaaccttcaactcaatatatcttgcctcctggacctaaattcagatcaagacgtattcctaagcttacattttagaattacagagtaaggtgtaggcggcatttgtcattctagtagtcaccacaccttaggtgggtggttgggcagaacagtgactgaaggatggagtgtgtgtccctaaacccgacacgccctgaaatcttcctgaattagtaagtcactttatccatatattcttgcacaataatggcgaaggggaagtaatttggatagctgctgataagacatttttgggcccgtgaaatggcaatacttcaaacagaatgggagtagctgtactaaaccaagcaaacagaattctttcgaaaatagttacggagtttctaccttgtagctgaggcttccgagcaagggtaaagtcagtcccttccctctgggagagataaagcacagtgcaagtaactggaatgcaaggcaggatgtgtctaagtgctatgtgagcgagtcatagcagagacattcttagagtgggttcttggaggaaatgtagagtgtaaaggcttgacagctcctaagaaaagcatcaatgaagagataatgaacctattcattctgccaatctaccaaatggtaagacgtaataagtttatgtagcaaatgaatagtgtaactgtgtctatttttacaggggacttgagctcatgagtaaagtccttccaagttgtcatttttgtttaaatttcccttgagcaataaagtaaaattcattcagctgccagttttatcatgtgttatgtactggctttagagctggaggggttgggaaatatgagagtttcatattaggagcaccagcacaggataggtagcttgcccaggatgaaaagtagcaaaataaatgccttgttatccacgtggcatatggcattctgttgtttagtgctttgcaatacagtgtggccatttcagtgaagggtgctaagactccagatacctaagtcttggcctaagccattatctatctctgtgttagtgctggaatccttggcattttctgacataatcatgcccaagcttgattacccaagttctgtagattgttcaaagtgtcccttgtgcttatctcatctatcagctcagctgtcatactcattcaacccttgtgccgaagactgtgtaagattcatcttcataaaacaccacataggatgaattaccagtttctgctcttgaaatctattgaatcactcctcactccacaccccattacttcctttctgttctcacctctactcagcctagttcaggccctcctgaactctctcatctgtcagttgtgagagctgagcttttaaattgatttccctggtgcaaatccatatttccacttgctgctagactaaacttcctgaagaagcattttactctccaacttataaaactttggtaactgcccattgcctgtagctctgttttgcagcatcgaaccccatgatatgcgttactgtcttcacagtcttcatgtccatctggacttgttatcttcttttaaatcagctcattttaaatattaaaacatgtattttaaaacatgtagcctcactgcaagcaataaactccatgcaaacatgagtcagggttagttttaatgtattcctctttacagtcaaatggacacattaagtaagaggaacaacattggtgggccacctaaaattccctctcctaagaggttgctcaccacactgatagtccacctcattattattattgcagcatttaaggaccacagcatggccttgaccttattcaccctcttctctctgtcagaactctccactccagccaaactggtttctttgtggcctccttaggtagtaactttatatattctccttagcttctgaaatacctttctctacctcctcctcctcctgatctgtgtttgtcttttccatcccctttggtcactcttcactccaactcatctcatctatagcagtgcctccccctctctaaattcttgcattttgcatcactgccttgtatcagtagttcagcattttcattttatctggcttaattctgtcctcattgtatcatacagtgtcagagttaagatgtatctcagagaacttttcataggactcttacttgatgtagacccttgaagctccttgaggacagcaatcacattattcctatcaagccccaaatgtgtgtctctcttttagggtttttcttactccagaagtcattgaatacaccattatttcaggatttttcaggagttatttatctagctcattctgctgatcagcagtgtttccaccagagatgtcaaagtcatacctttattatcttgccccccacttgtccctgttgtaagttcccacccttcacaccttacctcaatacctcctcacctcctgacctcatacattcagtcttcctagttttcaatccattttgttaccttcttctttacttccaaataataataaactcttgttttttgagacagggtctcactccattgcccaggctggagtgcagtggtgcagtcatagctcactgcagtcttgatctcctgggcccaggcaatcctcctacctcagcctcctgagtagctgacactacagatgtgtgctactatgcccggccttttttttttttgtagagatggggtctcactatgttacccagactgggctcaaactcctggctcaagtgatcatcttgcctcagcctcccaaagtgctgggattacaggcatgagccaccatgcctggccaataataaacatttttttgttgaagatcccatctgtgtctatctccctagttctctctttcttttacccttagccccaagttgttgaacataaagtctggaactcactactctttagcagttcctttctggcctcagacaagggagaagctaaacagttggggtcaggggcattcatgaggatctttgagtgatatttccctagagaggcccattttcctgttgctgatgctaacaaagatagttaacatttggcactggcagtgtccagacactgagctcagcactggtcatagtgtcctggttaatccttgcaacaaccctaagaatcagggactcccgccctccccattttacagatgatgaaatgcaggcatagggagattaggcacagctgttaatggcagaaccaggcattccaaagctgagactatactgtactgctcaaacgacacaggtgtagaaggtgtatggcagcctgagccccatttcctgtttgcatattcctgctcatacatgcacaggaatatatacttaatggggtacggtcactggacccttctcacttactctctcaccaccccctctgctcctgccattttgtgggcacccacatagacgtagtgctgcaaagtgagcctccttttgagcagatccacacaaaatgtgcagataaacaagccttctacctcaggcctgcagcacgcctgctttctgacctgcttggtacgtttcgggcccaaagtgtcagagtgtggattttcacaatccccctcccacattttaagtttgcaggcaaatgaaccttaatgtgccttctctacttccctccctccctccttccctctcacactcagagtgccagaaagaagaacctgctgactccaccactcgtctatatgtcttgactgtaggagagagagctttcctgatcccattcctatttgtggagtctgtgggagagcaagccatcttgccttcttgttatttctctccttcacccatgcatgacactgcaaagggtttgctggcttgagtcttctacacacacacacacagtctgagacatctgatgtgttcaccctcccatttgccttgaatggtagtgtgtgtgttttttaattccactcttatatacacaacttacaggagagtgaattttctagtgccacccccccgccataggctatgtgcccccttgctttttttcacccagcatccagagtcgagattgtttagtgcccttcttacaggccttgttggcaagagtgagcattattatgggacaccctccccacccccgacacagatgatgcacacaggagtacaagatgatgaggctcctgatcaccccacgcctccttagacctacgtctgtgtacatcctctgtctgtgagggagagaggaggtgactccttacctgtttgtctcacatgcctcacacattggggtgtgagctgtttcagttccctcccacacatgaggtttacagatgtgcaagctttttgagctgtgccctgccttttaaacccagcatgccttcttagtgcttttcccacaagcatgcattattggagagtggactttgctttttttttttttttttaacttgctgagttgaagtatttgaaggatagtgggcctaaaaaaactggctctggcacaggcacatgtgccttcacatgtgtacacacatgtacaccacgagggagatgaatccttcggcctgttagtgtttgctttgtatggtagatgtgttgaggaataaaaaaaataatctgccccttttagctgaggggaaaaataagttcagaaatggcagttgatccattaaggatggtgggcagtttctaagctatactctgttggccagcaagtttaaagactaaagaaaaagtgtcagtgtgaacacatatttggctcttttcactatagttggtgttgtcaagcagctgatacctgcggaatagaatatgagaattgtgctacaacgaatacatttgctttcttagtctgtacattaaaagcccctttttttacttgttttaaaggttgtggagcattgtttgaatgacaattatttacattgtaaaaatagtatgaaatttatgatattttaaaaatttgctaggattcatcagtgagcattcttcctatatctgccctgtctctgctctccactcccccagctctcctgccccatgcaggggtgcaagcctctcaagctatcccatcccaccttgaccacacagaactacagtgagctttttattttaaatatgcttccccaaacctgttggactgtgggtttccccatccgcctcctgcttgcagcctctctctctaatcctgcttttctctttctttctctcatgtgcatacactcatgatatgcatgtaagggagacacctgagttgccccattgcatccagcatcgcaggactgtgagccttctattgctgccactctcctaccccacgcatggcttaacctaaaataaaactgacctcccaattgggaggttattacaacctcccaatgcacacactggctgggccacagtggcgtgtgaaccactgtgtcagccaccttattaccccttttctgtgcatgcccccacacacatttatgataggagcttgagcctccttattctccatccttgctctttctctcttccttttcctccctcatctcacatgtgtgtgccaaggatgtgccagaaagtgggtccttatcattttcagttctcatacacatgtgggtacacacagctttagggttcagtggttaggcccactgtcttggtagtcagattacctgtggtagaatcctggcgtgatctgtaatgagctttgtgatcctagacaagtgacttatcttgtgtctcaatttccacaacatgaaaatgagataactaattgtgccaaccatataggtttgtaataagcactgaaggaggcgacgcatgtattgggattaacatgtaataaacttccttaatccatatgctttgcctggagcaactgattctccatagaagaaaactcacacctaagctgcttggtcccattatttgaaaatgtttgggaagtactgccttggatgactgtttcataattctttcctttcctcaaatctgcagtgtcacctcccttccttcctcctcactctcagctgctgactttgctttcttcttccttgagaaaatggaagccatcagaagggaccctctgaagttcctctgacctctcctccattacctgcacatgtccctaagtgtcagctcctccccattatggtagatgaattactggcacatgtagccaggaccagttcctccacttgtatactagatttcaacccctgtcacctattcagtgacagtgctcctgcaattgatccccctctccttactgcatcatcaactgttctttgtatactggagtgtttgtaccaatatctagatgtgctgccacatatcctgtctaaaaataattttaaaaattaaaaagcactaccttctctacccaaaaagctcctccagtttctactcatttctctgttcctctttacagaaaaaaaaaaaatttttttgaaggagctgattgtactccatctctacttctatttctcccatttactcttttttttaaatgtatactttaagttctagggtacatgtgcacaacatgcaggtttgttacatatgcatacatgtgccatgttggtgtgctgcacccgttaacttgtcatttacattaggtatatctcctaatgctatccctcccccctccccccaccccatgacaggccccgatgtgtgatgttccccttcctgtgtccaagtgttctcattgttcaattcccacctatgagtgagaacatgtggtgtttggttttctgtccttggatcccttccttacaccttatacaaaaattaattcaagatggattaaagacttaaatgttagtcccatttactcttgaaaaccctccatgtaaaactgtaacctgcagcacttaaatgaccctggtcaaggtccccagtgtccttcacatttcccaatttactgggcaatgttgtcatcttacttgacagatcaacacacagttgatcactccctctgccttgagactctacctgctttccaggattccacactcatgaggttgtcttcttacctcacaagcctctctttctcagtctcttgatggtttctcctcctcttcctgaattctaagtattaaagagatatagggcttagtcttcagacttctttttttttttttaacttctcattagtcctcagctgttctcatcttgtcttgcaactctaagtaccattttatgtggatgatttctgtgtttgtatttccagcctggacttctctcctgaattccagatgcctatgtccaactatgtactggacatctgccccgaatgtctaataagtatctcaaaactttaacacatccaaagctgaggtcctggttttcctccccctctcaaaaagccctactcctccctctgtgttctccaactcagcaaacagcatttcccaattgcatatgccaaggatatggagaattttaataagctaaaggttttggattcatctttgacactttttcccctccattctccaaatacaaactgctgtcaaatcttgttggctctactttcaaaatacatgtctaatctgaccacacagccacttctcatacttctcacttcctctattatttccacactaatccagcttttccctgggctgacaagtgcaagttctcttgcgtctgtctgtctgtctgtctctctgtctctgtctctgtctctgtctctctctctctctctctgtgtgtgtgtgtgtgtgtgtgtgtgtgtggtgtgtgtgtggacacaaagtggttggtggctgagagcttgagcctccttttttgagtcctctttctaatgacctgcatgccagattctaagctttcttaccatctgttctcgtatgtgtgttatttcatctgtaaaatagggataatgatcacctcatggatattttatgagaaataaatgagctatgtgtgaaaagcacttaaaacagtgctctgcaaatgtaaatactatactggtgttaggaataaaaataaaggaaaagaaagaaggaaggaaaacaaatatgttgtagatagtgaacatttctgaaggtacatatgtgaatgtacacaagcacaccttctcattacagcatgtctggggcacagtcatagaagtccaaggcatctgggatacgcatgcacacagtatacaggagagcagacctcccgacttgctttctctcctccatgccttgagtgtaggaccgttggcatcttaattaccctcccacacccaaggcttgcaaaaaagcgagccttctcttccctctccagtgcataggcatgagcacatggacaggtacaccaaagggaggtaaaccctctcttacgtgctctgtatgtggggtacactgttagcagccatcccatctggatgactgtcctgcttccatggccactgctcctagtttacccatcagcactcctgtggctatcttgctgcccacttgcaccccccaggccagtgcctcttgcctcctagagcatacccatatgtcgtgccaagagagcaagcccttccctgctccctctctcacatcccttgcatggtggagggtgagctttctgaaaacccctcccacatgcagggtttgcaggatggcgagcctcagctttccttgctctcttgtgcatgtgtatatacacatacgcactccttcaccaaaagaaaaacacacacccatgtggtgggaaggagaatgactctcagccatgtcctttctcccatctcagtcttacatggatcctgcaggagagggagacttctcttagctttctcttgcacatggtgcagcccctcatactcagggataggcacagcctagagaaggaaggggggtcttttgacctggttctgtcttaccggcacctagaggaggagagagaaccttctcaggactcctgtacatggggcatgatgaaaagggagtcttctagctaattctcacaaacccagtttgtgaggaaaattgtgtctatatcataaccatatgcaaagatgtaatatgcacacacattttgggttcagaaagtaaaatccactcactgtgccatgcctttccatatgcacacttgtttgctcaagagggtgtgtgaagatctgtcttcttagacactcatgtagatatgagtcagattgtgagttttctctgttatctccccagacccaggatttgcagccgattcatttggtgagccactcattcattcagcaaatatttatcgagcagctactgtgtgttgggtactcccctatgcaccagggatacaccagtgaccaaaagacaagaatccctgccctagtgaggggaggcaggtagtgaacaaaataagtaagtaatagatagtgtgccaattgttgataagtgctctggagaataataaggcaggaaaaggggacaaggagtgggtgggggtagttacagcatagatggtggtggagaagtttcgatatcaaatagggtagtcaggaaaggcctactgtgttctaggaacaacaaagagccattgtggcagaagcatagggctgggaagtagtaagttacaatggaaaaagggaaagctgataattactatgtatctctaaaatctaaggccgcttttaaaaaaaaaatcataccattatcacacttaaaaataattaccatccaggcacaggggctcatgcctgtaatctcagcactttgtgggaggctaaggtaggcagatcacctgaggttaggaattcaagaccagcctggccaacatggtgaaaccccgtctctactaaaaatacaaaaattagtcaggcctggtggcaggtgcctgtaatcccagctactcgggaggctgaggcaggagaatcgcttgaacccgggaggcggaggttgcagtgagccaagatcgtgccactgcgctccagcctgggtgacaagagcgaggcttcatctcaaaaagaaaaaaaattgccaacaattttttaatatcatcacatatctgttgttcccatttccacttgtctcagaaatatcataaattaggatccagataaggtccatgcattgcatttggttgatatgtatcttaagtccctttgaattatatctttcccttccatctatattttttctttccttataatttatttgttggaagaaagtgggccattcatcctatacagttttgcatagtctggatttttgtgatcacatccctgtgatgtagtttacatgttccttctccttgtttgtatttcctgtaaactgatagttgcatctggaagcctgatcaaattcaggcttaattttgaggaagggggagcaaaactacttccattaagaggcacaaaataactgatgatcatctttctgtgatgttagttgccaccgatgctcaattcttagagccgttatttcattaggggttgcaaaatgatgatattctaatcccattattctcttgatttattagctggaatacttctataaagaaaaacttcccttcatctgctatttgatcacccagtgttgccgtctttataggcaagataggataaatgtttggttctctttatttatcagtactcagaataatgagttggttcactagcttactctaaagaggattttttaaaaaaactattataataaactcatagatttaaatatatttggacttttaatccattgcagttcttgccttcagtgaagctccagtgccccatctttagccagtaggagcttcttcaaattggttcctcagtccttttgacatgcctccgtagttatctgatagcttctccgctttcagagatgaaaaaaatgtacaaagctcatcgcagataccttccccaggcctggaatctgccatgtcttcaagaagccctggtttcttttaatcagacatgatatttaaagaccatatttgcctctggattggtcattgtatttaggcttctacaatgatcagaacagaaaaatgttttgtttttgtgttttcttgtttctagataaatacatcatgattccattatacttctgattcaaaatcaggattacagttttctgtgtctttgcttcacaagtatggttctgactgttgtatggcaaataggaggagaaagtgcagaaactgggagaccagttaggaggccattgaaataattcagttgagagatggatggaggcctacatcagggtgatcgtggtgaaggtagtaaaaagtggttatattttaaagttacagccagttgagtttactgatacattgcatgtgaagtgtgagagaaagaggagtaggagactgagccctctcttccctctttgtcacatatgagttgggtacatatgctgacactgcctctttaatctgtagcatccgcatgcaagtgctgtcccagtgcagtacacctgggctaggactcacagatggtatgttatgcacagagcagagagtgcctgtcacctctcctagttcctttcagagagctttttgaatgcctgttggatttggggatccaatagtggcaagagcatcagggaccctggttttactgtggggtgagcttgtgccagagaacacagttcatcattcccattcagcctgccttcatgtgttcaaggggctggaaaaggggagctttttctttcctaactcccatgctatccttggggtacaggtgcctgagccttctcatttgctccttctctttaatccttgatactggtactagtgctctccacatgcaatgcaccttggcagggattcagatggggtgagccttagctgcagatggaaggacagagcccttgtacatcgcctacctctcctgctgcctgccagtattatttactcctgtagggagccagaagagaacagtacagccacagtcccctgagtgtactgcctagctagcacatataggaggataaagctcatttgtactcactgtgcaggtgtgcacacatgctggggatactggagaatgaatttactttagttcccaccccccaagcaccccaccttgtcccccaggatggtcaggcatttagggatgtagacctgtatacacggagtcccactgatcaggtaagcagtgggtggttccttcctgccctaactctactctctttgccctcccagaaagggcagtgagctgtctcggcattcttcccttaggtagctgttgaatgaagatgcacttccttgttaatgttctctctcacaatcacagatacacaaatactcgtatatgcacatgtgcacaagcaaggcatacaggagaatgagcatgcaagggaggcccacatgtggctgggtgcccagcatatgcagacatgtgagcatacagggacaggagagacaggagcctttttgattatactcacagggccagatgcccccatctttactcattttctgtctctctctctctctctttctctctctctctctctctctctctctctctctctctctctctgtcacacacacacacacacacacacacacacacacacagagagtggaacttctgatgttttccttcatatcccttatgtgaaggggcgtgaactttgttgacctagggagattgaaggagaacctcatcaactcacacgtgaggaatttaagaggatgaatctgtgtatccccttgtgcaggcactcacactcacagatactcggacctcttctctctcacctgtcccttgcatgcaggagtttcaccatcccccttaaaaatgcacattcattcaaacacatatatacataaaaatagagagtaagaggtaaaaatattgacggctgtgtgccaggtactatactttatttcattttcttgacaccatttaagaggtaggctttaaattgtcctcattcttcaaaagtgtttaacttgaccttgggaaaatcaggtcgattctctaggctaatatgtggtagagcgtgcatttgaaccaaggttcgtaaataccaaagtgcctggtttttccactacattagtgattctcccagtgtagtccctggaccagtagcatcagtatcacctgagaacttgttagaaatgcaaattcttgggtctcaccccagactcaccaagtcagaaacctctgtaacctgtatattacccaggtcttcagatgattctggtgcatgttagagaacaactgtgctaaactgtactgccttcttgttgcatagtcacacaaagcatttgcgggatcatgagctttggcgttatattcattctctctttcctccctttcacactcctctctcctcccagtctctttataggtttatacttttttgttgttactatctgagagaacagacaaaatgtgtgtttaactagacatctttaatgcaaagctcaagaactgttctctttacttctatatcatgacaagtaagtaccttgtgtgaagaagaatgagccctctcactgaacattcacagggctttgtgttctgctccccctctctaatccttgctacctgggtgagagtgctgtctgaatgcaatgcacctgggcaaggattctgagagcgagagcttcatcttcgtgtaggacagagcgtctttctgtcctcctatcatccattccacaagtatttattgaccaccttttctgtatatgatactaagttgagtaatgagcatacagttgctaacaagacatgcttggtccctaccctcatggagctacagttgaggaagaagaatggaattcctcatcatccattacacctacatgccctgagagtgggtgggccacagagtggacttctcattaccactgtcacccacaaacatacacaaaagcatgaatcttctctgatctcacatggaactctgcaggagaaaagattctctgcctttctgtaaagtccctagtaaatgacactgtatatacatgagagtgagacttggttatagctacacatgcacacatacaaacacacaaaaagggcaggtgtcagagccttcttgtctgctccccctcttgaatccttggaacctaggtgtgagtgctatttcagtgcaacacacctattcaaggattcaaagaggctgagccttgtctacatgtagaaggaccaacaacctgtccccttctttcacatgtttgtgtttgctatgcggtgccagatcctgcactgggtggtggagatacaacggtaaataagacagctaaggtccctgggctctgtagagggcacctgtgggagaatgaaattcatcattgccctggacaagcttacacctctttgagagcatgagctttctgtttactcccagcttactatgtgtcagatactgtaatggggaaacacacattgggtgatgagacttgcacagccagtctttgctctcagtgagcttatagtttaccagagaaacagaagagaatgaagtatcccaattttctgtaccatcttccaacatgtgcatgtacatgtgtgcccacatacagtttgtcccaacctccttgctaggccccaaatacatccagcacctgcagaccctcaagtgtgatctgaaaaagatgccactcatatctttcattctagtctgaggttttgtctgagagggcatgtccatgtggccttgtgcagggggatgaatacatatgctatccctgaggagaggcatctgtcttagcaaatgcacacagagatactttgcaggaatgggaccatgaaagtcaaatatatatggagatatacatgcagggtgcaggtgcctgagtcttctgctctgctcttcctctctaatcctttgtccctgggtgagagtgctttctgaatgcaatgcacccgggcaaggattctgagagggtgagccccctctgcgtggagaacagaagatctgtatgtcacctctcagctgcttgctgcttgcctgcctgctctctgaccctcattcattctttccttccacaaataatatgtattgggcaccatgatgggcattggacacagagaaatgaacaaggcagacttcgcccctgccttcctggatattatagcctgagaggagaatggactttgtcaccactcattgcccctgcatatactgagggtgagtgggccacataggaacttcttatctaccctcttcccaccttaacccacccataagtgtgagtcttctcattcctgctgtcacattgatacttgtttcttgttttttccttctttccttccttccttcttttctttttctttctctttcttttctttctttccttcctttcctttcctttcttttcttctctcttttcttttctttcttttttgatggagtattgctctgttgctcaggctggagtgcactggcaccatcacagttcactgcagcctcaaccacctgggctcaagcgatcctcccacctcagcctctcaaatagctgggaccacaggcttgtgccaccatgcctggctaatttgtgtttattttttgtagagatggggtctcactatgttgcccaagctggtctcaaactcctaggctcaagcagtccaccagccttagcctcccaaagtgttgggattataggtgtgagccactgcacccagcctgatacttgtcgaagcaacttctctctactttagttcaatgcaaggttaatgcactaggcaagaacagcaagccttcttgttagatgcacatgtgaggtgtacaggtactggaatctcctgtcctggttccccctctctaatccttgctacctgggtgagagtgctttctgaatgcagtgcacccaggcaaggattctgcaagggggagtgacatcttcgcataggacagagcacttctacctcctccttccatcctttctatgactatttgttgagtacctacctactctattgcaggtgctgtcctgggcagttggcccacaagagaatgagccatatctggttccctaccttcatggagtgtacagttcagggaggagaatggactccttctcattcattatatctgcatgtcctgagggtgggtggggtacagggtgggtggggtacagatacatgttggagaatctactaaacctcagtacaatcacacataaatacgctgtgtgcaagagaaagggcctgacttggttacatccacagagacatgtcctcacagagtggtccctctgacctggtgcatcactcacattctttcagcctgtgtgccagtactgccttgactcactgtcccttttcaagaattccaagggaagaagccttgtctacacttaaaaggacagagcttttgcacatcaactctccctcctcttccttccacagatactcaagtgtctattagacagcaggtattatgttcatcaccaaggatatagcagggatcaaaatggacaggttgctaccctacattctggtagggactcataaacacactatacataaatgttgtggatgaataggccactgttcaaaagaatgaagtagatctatatgttccttgttacccagtctgcatgcacaagcatgtgcaggttctgctcaagtgaaattctcaaatgtccccaatccttgtacaccagacacactcagagacatggccctgcatgcagagaaccccacctactgaaagggtaggagatggagcctgttgtgctctcctctctcccattctcagcgtgcaagccagtgagcttccttaactcccttatagatggggattaaatgagggaagtcttcttactgctactttccttcttgctgctctgtataggagagatcctttcattacttttctgtacagtcacagatgaacacactatatgcggtgagccttccctgtaaacccatgtgagcacatgtgcacacacgcacacgtgcacacacacatactctgtatggctgcttgggccttcagtcctgttccccctcttgaatcctggtacctggatgcaagtgctgtgtcaatgcggtgcacccaggcaagcattccacggctgagccttttctgcatagagcgaagaacacctgtttataatccccatccttcattcattcccacctttaacaagcaggggtggcgctcctgtcatgcaccagacatggagagacagggtggtcaagaaagacacagaactcatactcacatgcctagtgagcatgtttaagagaaggaacttccgttgcccacattgttcatgcatacgtatgtagcagagagtgagtcttcccatcatcccctctccaaccccccaacagtgctcagctagagaactacaaaaggtgtgtctccccttacacagagctgcagccacagtgtgcataggataatgagtgtcattagcagcatcttctcactcatgtctggtgtgcaaggcaataggctttctacttgctgcttatgccaccagagcttgaaggaaagtggccctacttgtcagtcatctcacacatgcatatgaagaaaagacacttcacctttgtatggtcataggaaaatcacctgtgagccagagagtgctgtttcttttgtacatacacacaaacacaatggatttgaagatgctcgagccttctattcaggttgtccctctctttcattcttcgtagttgggtacaaatgctattccagtccattgccttgtacaaaaattcagagagggaatctcatccatgtttaaaagtgtagagtctttgcatcacccctctatgtcccattatttcatttctttaagttatgtatagagcagtggttctcagtgtggtccctgggccagcagcatctgtatcacctaggagcttgttcaaaatgccaattcttgggctcatccctgacctactacaccataaaccatggaaatctgtactttaccaaggctctcaactgattctgatgctcacttaagtttgagaatcactgatttagtataagtgctagctaggggcagtgataagctagtcaggtgaagggtggaagagaatgagctcctgcattgctcatgtacgttcccaatgccgagtccatgcagactgtggcagggaagccatcatttcattactgtctccacctcctccataaccacacattcagtgagcacatgaggctaagtgaacacacaacaagtactttattagggaatagacttggcactgcttctccaggcgtgcacctgacactttaatctcaatctgtctctctctcaatcaatcaatcaatctctctcctctctctctctttctctctttctgtctttctttctctctcctcccccacccccctcccatgtgcagaagaatgaactgctccttctcccatacccattgcatatcggagttgtgaattctcaaaacacctcctgtgtgcatggattacaggagggtgagccttgtcatcgtgaatcttctgctgaacaatccaagtagcccgtgtttattgcgcacttttgatgtgccatgagctgtgctgggagtaccctgctaaataatggacagtgtctctctccgggacttcctatctagtggaggtattaggtgcctagacttccccaggcctaggcaacagacacaggtgtgtcaggaattgagccttctcattctcttatgaatacacatgctcacattgtgcatgcatgtgcacacacacatgtgtaagtgtagaaacatttctgtacaaagctgaaaggaaggagccttattatctaaacttgcctgcaagtttccttgccacacacactcagatgcatgcctggtgtgcaggtgcctggactttgatttttgcttgccctttcctagccttgcagcctaggcacaagtgctgtcttagcagtgcaatgggcttgtgcaaggataccagcttgtgagccttgcctatgtgtaggacagagcctgtccatcccttctctttcctttgttcattctttcagtcagtcatttgtgtgtgcatgtttttggtccattcatttattcatccctttaacaaatttactgaattcctgctgtttgggaatgccacagtaaactaacctgtcagagatgccgaccttactgtctagcaggctcatggagaataagcatcctcatgtcatccaacttcctgtgaatacatgggctcagggtgccagaaatcaggcttttctttattccctcccacagacatgggtacctgtgcaaatatatgtggtgtgcacatcctgagcctgctgctctgcttccccttgtatccttgccacctaaatgtgcatgctgtctcagtgcagcacctattccaggactctcagaggggcctttttctgcccatagacagacaaagtgcctgtgagtcacacttcctcctccctctccttcccctctacctccctttcacaagtattgagcacttagtacatgctaacgctgtgctgccagggcagtgggcatatggtatcacacaagatggacttggttcttgcctcaaagaatatgtgtaggagacttgactttttgtcacctaatattcctgcacgtgctgagttagtgtgggccacaacatgggacttcttattgacaccctctcccaacatatacacaatgcaagactctcattcctgttctcacacagagctgtgtaacagagaaccttctctgcttcgagcacggcaggtgcccaagccttctgccctgctccccctctctaatccttgctatctgggtgctagtgctggctcaatgcaatgcacctgggcaaggattcagagagggggagctcaactgtaccaagaaggacagagagcctagacatcacccctcccaccctcccctgtcatagtttttgagtgatgggtgtgtgttggggaagcacagaacagaatagttagggacttcaggtgctctggtgggcttgtctgtgtattagaataaatgtccttattaaataatgtccatgtatgcaggtatccagagtgagacagtgagctttctctgtgttccccacctgctgtccacacacagggtggtgggcgggaaccagagccttctgatttgctccctcacttccttccaacctagatgtgagtgctgtctcaagtattaagccaaggattcaatgagatggagccttgcctacctatatgtatatatatggactgagtgcatatatgtctcttttcttgccttcctatatcttgagtttctagagtgtgacagatactctttttagtgttaaggatgcagtgacaaacgagagtcaaaatcactggatgtgctctctgatgggcagctttagaagaaaaattcagacgggcacaaatgatgggggccaaagagagagtcttcctattccccccactctgtcccctctgaggacagggagatgcacacattcatgaagatttacacttacagaatgtataggagtttgagcttataagctgccctttatcttccaggacatcctgagtagaactgtgagctgcctttagatgtctattacagactcttcttgaattagagggggtgaagagcaagggacccttcttattgctgatcttgtatgcaccccacacaatatggaaatgagaacagcctatatctttatattaccttactttagtcaaatagagatggactatacatgtctctgtttcagtctatcgctctctctgtccgtctctccatctctctctctctctcacctagggagtacaggtgcccatgatctgattcactcccctcctcccatccttagcgcctgagcctgagtgctttctactgtgacctcagcagtattcttcagttgttactctcttcttagctaagctgatctattcattcctccccatcttatcatttttgctcattgcccattgcaaatttatagtgttcaggtcagcgtagcaatacagtattataaatagtggtgacagagacagaaagagacacacactccatttcagtcctcaagttcttaaacatttgggacttatagattctgatccttggtccttcttctctcccagattctcccaatctaacctgcagtaaagattcaggttatttaatatgtgctccttatcttttgtatactctaaaatctcattttggttactgctcagccttagtcttattttatcagactttatacctctcttgatgcccaagactagcagcatcagcatcctccaggaacttgttagaaataaactttcaggcctcacctcagacctaggtaatcagaaagtcaggggtggggcccagcaatctgtgttttaacagccctccaggtgattctgatgcacactgaagtttgagaaccattggtttaaatgacttaaaatttctattctgtcattactagggggatttctgtgttacacaggatgatttttagcatcaaaatttccttatgtgtaaatggctcttttagtttcttttcatattttaaaaattcatagacttttttgagcagttttaggtttacaaaaagattgaatggaaagtatagagttgttatatattctcgagacaccccagtttccgctattaacatcttgcatgagtgttgtacacttgttaaaattgatgggctaatgttgagacattattattaaataatagtataattataatgtattataactattattaaataatagtttaaatataattattaatgtaaaccatagtttacattagagttccctctttgtgttatatactctatgggttttgacaagtgtataatgacatgcatgaccattatagtatcatacagaatagtttcactgccctaaaattcctctgagttctgcctatttatcccccctcccccaccctaaacccctggcaaccgctgatcatttttctgtctccatagtttagccttttccagaatgtcatatagttagaatcatacattatgcagccttttcagaatggcttattttacttagcactatgcatttaaggctcctcatatcttttcatgacttgatagctcatttcttttctttcatttttttccccatttatcccatatagtaaccagcttatttctttttatcactgcatagtattccattgtctggaggcacaaagtttatttatcctcacccactgaagggcagcttggttccttctacattttggcaattatgaataaagctgctataaacgtttgtgtgcaggatcttgtatggacataagttctcaactcacttaagtaaaataccaggaagtgttgctggatcatatggtaagactatgtttaattttgtaagaaaccaccaaactgtcctccaaagtggctgtaccattttacatttccatcagcagtgaacgagagttcctgttactccatatcctcatcaacatttggttttgttagtgttttggattttaggcattctaataggaatgttttcttatccttgagcttaaagagtttcttacttattttagatacaatccctttctaagatatgtcttttgcaaatatttttcccatgtgtgatttgcttttacattcaattaacagtggcttttgcagagcagaagtttttaattataatgaagtccagtctatcaattttttctttcatggatcatgcttttggtgttgtatctaaaaggtcaccaccaaacctaagatcacttagattttagcctacattattttctaggagttttatagttctgtgttttacatttaggtcagtcatctattttgagttaatttttgtgaaagttgaagacctacctctagattcgtttttttttttgcatgttcatgtccagttgtttcagtaccatttattgaaaagaatatatttgtgtcattgtattgcctttgctcatttgtcaaagatccattgactatatttttgtgggtatatttctggattttgttctgttctattgatctatattcttatgccattattacactgtcttgattattgtagctttatagtaagccttgaagttggatagtgtcagtcttccaggtttgttcttctctttcaaaattgtgttggctattctgggtcatttgtctctctggctaaactttagaatcagtttgttgatacccacaaaataacttgctggaattttgattggaactgcactgaacctgtagatcaagttgggaaaaacttacttcttgacaatattgagtcttcctatccaagttcatggaatatctatttatttagatctttgatttgtttcatctgagttttgtagttttcctcatgtaggtcttgtacatattttggttagttttatacttaattatttgatttttagaactaatgtaaatagcattgtgttctgatttttcaaattccagtttgtcattgctagtgtatgagaaagcagttgatttttgtatattaaccttatattctgcaaccttgctatagttactcatttgtttcaggagttgttgactctttggattttctacatcgacaatcatgtcatcagtgaaaaaaaagtttttatttctttctcccactctgtgtatcttttacttcccttccttgtcttttttgcattagctaggtctttcagtatgatgttgaaatgggttggtgagaagggatatccttgctttttgctaatgttgctggaaaagtcttgagtcttgtacaattaaatgttagctgtaggtttttgtagatgttctttatcaagttgaagaagttcccctctattcctagtttaattagagtttttatcgtgaatgggtgttgcgtattgtcaaatgtattttctatgttgatttatatgatcatgtgatttttcttcttaagcctgttaatatgctagattacgctaatttatttttgaatgttgaactagccttccataactgggataaatcccacttggtcatgatgtacatataattctttttatatattctcgtgctcaatttgctaatatgttcaggatttttgcatctatgttcatgggagatattggtctgtagtttagctttcttgtaatctctccattcagttttggtattagggtaatgaattaagaagggttccctttgcttctatcttctgaaagagattatagaaaactggtacaattttgtctttaaatgtttggtagaatacactagtgaatccatctgggtctagggctttctgtcttggaagtttatttattagtagtttagtttatttaatagatacatgtcttttcacatgatctgtttctccttgcatgagttttggtagattgtgtatttcaaggagaattgatccatttcatctgaattaatcaaatttgtgggcatcaaattgttaatattcctttattatctttttaatgaccatatgatcgatagtgatggtctctattttattttttccttaattatttttacattgacatgtaattatacatatttgtggggtacacagtgacattttaatacatacaatgtatcacaatcagatcacggtattattttgtaataccaaaatacaaaaagtaatttgtgccttctgtctttcatgcttactttttttttttctttttttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcacccactttttgatggggttgtttgtttttttcttgtaaatttgtttgagttcattgtagattctggctattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcaggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttctttccttgagcagtggtttgtagttctccttgaagaggtccttcacatcccttgtaagttggattcctattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcgatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgggggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttataggcatttagtgctataaatttccctctacacactgctttgaatgcgtcccagagattctggtatgtggtgtctttgttctctttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactgtgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtttcgttgatctgtctaatgttgacagtggggtgttaaagtctcccattattaatgtgtgggagtcttaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagttggttattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcccgaggcttctgcattcttcacgtagttctcgagccttggttttcagctccatcagctcctttaagcacttctctgtattggttattctagttatacattcttctaaattttttttaaagttttcaacttctttgcctttggtttgaatgtcctcccgtagctcagagtaatttgatcgtctgaagccttcttctctcagctcgtcaaaatcattctccatccagctttgttccattgctggtgaggaactgcgttcctttggaggaggagaggcgctctgcgtttcagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttccccgctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgcctcgccctgcttcggctcgcgcacggtgcgcgcacacactggcctgcgcccactgtctggcactccctagtgagatgaacccggtacctcagatggaaatgcagaaatcacccgtcttctgcgtcgctcacgctgggagctgtagaccggagctgttcctattcggccatcttggctcctccccctacattagccccttttcataacttttcttacaactttcacaatcttcaacatgccttaactttctgccttccttttacactcttcgttttcgtagtttcaccttctgtgtctttctttgatttctgtctcttccagtttctctcttacttactctttccatctatttatctctctctcatttgcactctgtttctctctctctctctgtcatcccgtttccttttcccctcctgagttctctggctcccaccaccggcaggcctttcatgcttacttaaccgggctagaggtttatcaattttattgatcttttcaacgagccagcttttggttttgttgactttctctgttgatgtcctgttttcagtttcattgatttctgctctaagttttattacttcttctcttctgcttactttggattcaattcttttaatttttttagttacctaaggtggaggcttagattattgattatagatctttcttctttattaatatatgcattcaatactataaatatccctctaagcactggtttcactgcatcccacaaattttgataagtggtttcttcattttcatttagttcaaaatgttttttaatttttctttagacttctttaacccatgtgatatttagaagagtgtttaatctccaagtatttgagttttcaagctttgtcttactgatttctagtctaattccattgtcctctgagagcatactttgcatgatttctgttcttttaaatttgttaaagtatgttttatggctcaaatgttttctgtcttagtgaatgttctgtgtgagcttgagaagaatatgtattctgctgttgttaaatgaagtgttttatagacatcaacttgatctagttgatggatgatgctgttcggtttacctgtgtctttactgatcttctgtctgctgtatctgtcaattactaatagaggggtggtgaagtctccaactataatagtacattcatctatttctccttgtatctctatcagtttttgcctcatatgttgacgctgttgttaggtgcttatttattagagattattatgtgtttttagagtattgacccctttatcattatgcagtacccctctttatcgctgataattttccctgctgtgaagtctgctctgtctgaaattaatatacctactccacatttgttttgactagtagtagcatgttatgtctatctctgtattcttgaagagatttctgaagatgtctgctgtaattctgtccttgctcctccataggtaaaaggtaaggtatttgttttaccccggcaactttgaagatttttttcctttgattttctgcagtttggatatgatatgcgtaggtatagatttttttgtattcatcctccttagtgttctgtgagcttcctgcctggacctgtggtttggtatctgtcattaatttggaacaattcttagtcattattactttatgtatttcttctatttctttctttctttctttctttctttttttttttgagacgaagtcttggcctgttgcccaggctggagtacaatggcttaatctcggctcactgcaacctctgcctcctgggttcaagtgattctcctgcctcagcctcctgagtagctgggagtacaggtgcgcaccaccatgcctggctaattttttgtatctttaggagagatgggatttcaccatgttggccaggctggttttgaactcctgacctcgtgatccgcccacctaggcctcccaaagtgctaggattacaggggtgagcaaccaaccacgcctggcttcttgtatttctttcttctccttctggtattccagttatatgtcttttgtaattgttccacagtccttggacattctgttccttttccattttctttctctttgaatttcagtttcagaagtttctgttgctatttcttccagcttgctcattctttctctgctgtgtccaatttattgatgaatcaatcaaaggcattctttatttctgttatggtgtttttgatttctagcatttccttttgattctttcttaagatttccatctctctgcttacattactcatctgctcttgcgtgttgtccactttttccattagggcctttagcatattaaacgtattttaaattgctgttataataattccaacattccttccatgtctgactctttatcttcatgcagtgtttttttttttttttgtcctttagtataccttgtatttttttgttgaaagctagacatgatatactaggtaaaagtgactgaggtaaatagacctttagtataaggtttatgtttatctggataggagttaggctgtgtttacatttgttgtaactaaatgtgtcagaggctaagatttccactagtgtctgtttttgactgttgtgtatttgggtttccatttccctagagacttcttaactaaatttaaaaggtacagttctttcagtcatattcccctgttattatacaggatctctatagaagtaatgataaaatgttgagagaatggaagcattctgtagtcatatgattaggtttcagttttttagtgagcctgtgccctcagttatgactttgaaaagtgcttctccctttcgttttgttttttccccacttaggtaagatagaaaggctggtgggagatagaattagatactgactttttcccaagttgattaggccctggtaaaatagtttttcatgaaggtatgccttataagaaaaaccaaatgctctggttataattgtaaaatgactgtttcccctccccctgctggaagcagaaagagctttttctctgatcttcactgtaagaacaagaatgttttaggactcctggaggtaaaactcttcaaagtgtgaggtccccctaagactgggctccctggagtttttaagcttttgagcttatccacactcagcctcctcagttatagttaggttttcctaccccagagaacctaaactgtaagtttctgtttgtgttcctatggaggtttctgttcatgtaagctatgagtctgtatccatctgtctctttctctaattttgggggaagcagtttgccctgtgatctcagttctctgatggagctgagaagagttgttgatttccagtttgtattgtggggatgggagtgatgacttccaagcttcttttacagtggacttgaaactggaagtcatactttgatttttacttggatatttgcatccaccttttccttagcctttatcagtgatgatgcagatatgtcctttttctgttcctttcacttcattttattgcatacattccctgatgcaagaagttatttctttattttagtatatatgaattaatcaattttttgtctttctggatcagaactaattttgtctgttcacatctgggacaaatatactattctatgttttttaaaaaatcaacttttaaaaaacccatctggaatgtttgcactgtggtacatgttgtaattctatattccccatttcgataccaagcgattcctcaactatttactaaaaagtgagtatttccttatatttgtgttgcttctgatttagcaactattaagttcaaatagtttggatccattgctaaactttctattctttttttttatttaagttttagggtacatgtgcacaacgtgcaggtttgttacatatgtatacatgtgtcatgttggtgtgctgcacccattaacttgtcatttagcattaggtatatctcctaatgctatctctcccccctcccccgaccccacaacagtccacggtgtgtgatgttccccttcctgtgtccatgtgttctctttgttcaattcccacctatgagtgagaacatgcggtgtttggttgtttgtccttgcaatagtttgctgagaatgatggtttccagcttcatccatgtccctacaaaggacatgaactcatcattttttatggctgcatagtattccatggtgtatatgtgccacattttcttaatccagtctgtcattgttggacatttgggttggttccaatgaacagacacttctcaaaagaagacatttatatgcagccaaaaaacacatgaaaaaagctcaccatcactggccatcagagaaatgcaaatcaaaaccacaatgagataccatctcacaccagttagaatggcaatcattaaaaagtcaggaaacaacaggtgctggagaggatgtagagaaataggaacacttttacactgttggtgggactgtaaagtagttcaaccgttgtggaagttggtgtggcgattcctcagggatctagaaatagaaataccatttgacccagccatcccattactgggtatatacccaaaggattataaatcatgctgctataaagacacatgcacacatatgtttattgcggcactattcacaataactttctattcttaccccagtgccataaggttttgatgattgcttctttgtagaagaccaaaatctacagataaatttgccatatttacatttaaggaaatacatatactagtatctgtgtctacttattcttctagatgaatatcactaccagtctgtcaagttatataaaagatgccacggggactttagattaatatatagatgtaacataattcaaattagagtctatttcattcttgctatatttagactttccaatcaagagcataatacatctctgttgatttatatcttccttttttcattcttatttgtctttttataaattttaaagtaatactgtgtttcagtatgtctccatcatatatgaattcttttatcattatattttctagttctatggttatatgtaggaatgcagtttttagtagatttacctcctaatttatgagttcatatattacttttggctatttttagttggtatttttgtagttgtataggtatgcattcatgtaatccaaactggaataccatatatcttccttttctatacgcattcctcatttttgtccttttaaagcttttcttgtaccgtgttaaatataattggcaacaagaagtatcatgccttcctgtattaaggggaatggtatttgcttcttggttttttaatttagatattctacatcatgtcaagaaagaaatcctctacatggaacattttaaacttttaaatacagaatgactgtaaatttaaaaatcaattcctgacatctgttgagataagataattatggatttaaaatttttatctgttaatctgataacttatgttggtagtttcccatgtgataccggtcttgcattcctggaataattccttcttatatatagcaggcaaatctttcaaggtgatgctatatttagtttgttaaagttttatttaggagttttgcatgtatgttccaaagtgaaagtgatctttacatttctagtgttgtcttcgtcaggcctggtagacccttgtccttgatcctccagggtgcttctctacacttcacatttatgacactcttgaaagcctgtataacagggtatttcttatcatatctgaagaatctctgagatagcaccaaagaaaagctgattagctaagggaacatagcatattattgttttaattttaatttacctgaatttttaaagccattaaaaaacaaattatctaccaatgtattttgcctattcatctattagaatccaattttaatgattcaaacaatctctctctataggctgttactcctttgggcgaatttacagaaaatattagtttatttgcttcactttcccagctgtccacatggtctcttctgactggtttgtcctcttcctctttctcatcaactgtgggtgttgcccaagtacaatttgtccatgctgagttctttctttacttcagacattctcacagtatagtctgtgagttattgagacccttttagggggtctttaaggtcaaaactattttcatattaagatattatttgccttttttactcattttctcatgaatatacagtggaattttctgcagactgtagtatgggtgaagatgtcattcctctgagaactagtagaatatgttaagcagaatccagtaatcctctattaacccagacatttgagtattgtgacatttaaataaatcattgtatattttaaacatttttccattttaatttctttattattattattattatactttaagttttagggtacatgtgcacaatgtgcaggttagttacatatgtatacatgtgccatgctggtgtgctgcacccattaactcgtcatttagcattaggtgtatttcctaatgctatccctcccccctccccccaccccacaacagtccccagagtgtgatgttccccttgctgtgtccatgtgttctcattgttcaattcccacctatgagtgagaatgtgtggtgtttggttttttgttcttgcgatagtttactgagaatgatgatttccaatttcatccatgtccctacaaagaacatgaactcatcattttttatggctgcatagtattccatggtgtatatgtgccacattttcttaatccagtctatcattgttggacatctgggttggttccaagtctttgctattgtgaatagtgccgcaataaacatacatgtgcatgtgtctttatagcagcatgatttatagtcctttgggtatatacccagtaatgggatggctcggtcaaatggtatttctcgttctagattcctgaggaatcgccacactgacttccacaatggttgaactagtttacagtcccaccaacagtgaaaaagtgttcctatttctccacatcctctccagcacctgttgtttcctgactttttaatgattgccattctaactggtgtgagatggtatctcattgtggttttgatttgcatttctctgatggccggtgttggtgagcattttttcatgtgttttttggctgcataaatgtcttcttttgagaagtgtctgttcatgtcctttgcccactttttgatggggttgtttgtttttttcttgtaaatttgtttgagttcattgtacattctggatattagccctttgtcagatgagtaggttgcgaaaattttctcccattttgtaggttgcctgttcactctgatggtagtttcttttgctgtgcggaagctcttgagtttaattagatcccatttgtcaattttggcttttgttgccattgcttttggtgttttggacatgaagtccttgcccatgcctatgtcctgaatggtattgcctaggttttcttctagggtttttatggttttaggtctaacgtttaagtctttaatccatcttgaattaatttttgtataaggtgtaaggaagagatccagtttcagctttctacatatggctagccagttttcccagcaccatttattaactagggaatcctttccccattgcttgtttttgtcaggtttgtcaaagatcagatagttgtagatatgcggcgttatttctgagggctctgttctgttccattgatctatatctctgttttggtaccagtaccatgctgttttggggatgccctctctcaccactcctattcaacatagtgttggaagttctggccagggcagttaggcaggagaaggaaataaagggtattcaattaggaaaagaggaagtcaaattgtccctgtttgcagatgacatgattgtatatctagaaaaccccattgtctcagcccaaaatctccttaagctgataagcaacttcagcaaagtctcaagatacaaaatcaatgtacaaaaatcacaatcattcttatacaccaataacagacaaacagagagccaaatcatgagtgaactcccattcacaattacttcaaagagaataaaatacctaggaatccaacttacaagggacatgaaggacctcttcaaggagaactacaaaccactgctcaatgaaataaaagaggatacaaagaaacggaagaacattccatgcccatgggtaggaagaatcaatattgtgaaaatggccatactgcccaaggtaatttataggttcaatgccatccccatcaagctaccaatgactttcttcacagaattggaaaaaactactttaaagttcatatggaaccaaaaaagaacccacatcgccaagtcaatcctaagccaaaagaacaaagctggaggcatcacgctacctgacttcaaacattttaatttcaaatacaatatatatctatagatgttatcgatataaataaaagctctttaagggtcctcagtaattttgatgactaaagggatcctgagagcaaaaagtttgagaactgctgctctggtattgtctgttcagagtcctcacctttttctcataacccctactcgtctgtaggaataactcccagatgaagactactctgtaagaagaagcactactatttcctcctggaattctagcctgaaatgtctgaaattctaacaggtggagaaagtgctatgggttaagaattagtccaagcctctgaaataagcacgttctatggcactcagagattaacatgcaagatttgcatttgatttccatttctcaaaataaagtaactaaaactggaaatggagtataagctagattattttctgagccctcgctttgtgtcaggcacttgggagcacagatttcagtaactctgtccttgagtagctcaaagtatagtgggtagacagaaggtgattttatgtgtgtgtcagctcctattgctttcgctgctttacttcggattgtcttaatgttttattttaaatgatatgacaatacttgtatgttcgttaattgtataatgcatctctaatccccttcttcctcttgcattctcccttttctgtgtttgcagtatccggcatatattacttacccagaatgccatgtataggtcaacagatacttttgtggagcaaaaataagaaagaaatagaaaagtttattgtttctctgtgcttgctagcagtgaaatatgtgacatgctttgtattttcatttgtggggtcgtgtgtgtcagcccacctgttgttttatacatttgtttttgccaaatgggttagttgagatggtattaatttatttgaaccaacacatgtcaatgtcactagtaaaacaggatgccagtaagccataccacaaactagcaccatcctgtccacccccaccaagggcccttgccttgatcttagtacaattattgggagtgtgtactcttccttcccttttccttctttctcctccaacctaaatcacctacattgaaattggaaatggcaaactgccttaccagccctttcctcctcttctcttccagactactcctgccacacttacctcctaaaatgatgtttttatcatgttgctcctcaaaaacctcagtgactccattgacttaccaggtccttcatgacctgtctctatccatttgttcatagacaccttccttgtcttctagccaagcacgaatgccaccttcattctcatcttcaagtctttggccattttgtttcttggtcctggaataccctctctcctccctgaagtctctagctagcaatctcccattccattttctgaatgccaattgtaacaatttaacacctagctgctgtgtaattgcatggtgtgaaggttttcttcccaactagatcataaattccttgagagtaatgatgaagtaataaactctttttatctccctaattcccttccctcatagggcaaggtaaagatttattgagtgtcagccatataaatatgttgattacctcttaacccttcctccccaactggaatactcctcagtaagcatttattgaacacctactctgagacaacactggagttgccagaacaatggaagtgagaaggacatggtgtagtcacaagactcaagtagaagagattatgcagtcaacatagatatgtgaacaaagggaatgttgagaggaaagcctatttgagctggccctaggtatgttgaatggggttttaccatactgaaaaaagaatggaggtgggggtgggtgggattccacatagggcagcttgcctgagcacaggcatggaggcctgaaagtacgtggcctaggtagggtataacaaatttgtggcaagagataagtctgttggtgtggatgggatccagatttgatagggcactgaatgccatacaaagaagttttaaacttaactctctacgcatggggaaccagcttataattttaagcaagaaagtgacaaagggcatacaagctttgtaacacaaatatcagccaaacaacaatttcccctgtttgctgtccttcttagctctcaattgcatggcaagtcctatctgtaatcctctagttgggaaaataaatcaaatcccattacatttgttcctggcctaccccaaattctggctgacctcaggcttgtggccatctagaagtttaatttcttccagatgtgccattctctagactgacatgtcgttgtgaagccccagtgtgttatggaaagagcactgggcttggagttcaactatatatggattcaaatctcaactctaaggaacattgaattggtttctcattactctgcagctttaattttttctcttgaacattcttctaaagactgtatcaaaatgggcaatatcacttgcaccatgggtaagtaccactttcacttttactgattatattcataacatctgttttgcttgatttacttgcttcttccaattttcttttgttgaccctttctttctatgcatttactaaaaggacgctttataacccaaacagtgaaccagatagctgctgcaggaaatgtttgaaatgaggcagctcaatttagctggattgttctgtcagtgggttacaggaagaagttcgtaaggtgcctaatgaggaaactaaaaagttttccagcttctcctttgttgggtcttcatcttatagtgtcattattttgttttaatgaattcccagaacaataggtacacccatctgaaactatgactacaggacacattccaaagccagagataagttatttttggactccctgtacctttacttcccatgatttgtttggctaatgtagagttgctggaaccatgtattttaaatcacttcctgagtgaaacataaccagcgaggggagagagagggaaaggaattctgcattactttgcaaattttcttgctttttctttctgtgctagtcaccatatgggactcatggacatttaataaatttacactaaaagaaaacttactgaattgtgctactctcttagcctcagttcttctcatcagctaaaatggttcttgtttttagctaagatttgtagaaaccttgagtgcctgcttgcgaggttgagtgctttttgtaggtttgtcaaatgtaaatctcagagtgagacaaacattaaccataaatattgactctgatgctgcctacatttataaaggaaagatgatttgtcttgtttggattttattatttgtgtttaggttaatattattttcactgttttttcccttgtcctgctattaaggttaaagtagcaataaaagtgtctattggagttcttggtaattcaggactgtagcttgagggagaaatgagagctagaaatagtaagtttccttaataaatcaggttaaatctgggaaatatctgttatctgagttacataggagctaagatccagagcaaagtggaggggctgtttgttttcttttttctttgtatttattttgtttgtttaaagaggacatctgtgcatgtaggtggccttgcttagggagtcagagcccaagtgatatgagaagggcacccactcaggtggttggcttgaatactagaacttaaacacattgaagatgacatctggacttccacatggatatatggcttgctgtgggtgtcagaggctgagcagggtaaagaaggaatctacatggagtagtagttcagttgtgtgagtcaacctgacaggtatgaggagatcatctgtgcagagaagagttgaggaaaagataggagactggttatatacaggaggattgttcaagaaagtaaaaaaattaaaagatttttcattgttaatgaaggggaaggtacatatataggaagagaaaagactaaattgagccttgttatgttggattggaatcagatataagtgaaaacttatgttttttacatgtgtaaatattgatatatgtaaaacatacatgttgtcaatatatataggtggatgtgaaaatatatgtgaaagtgtgtgtgtgttccctacctatgtccattggggagcagcaacccgaataacaatgagcacccagaacatgtcttttaaataccacccccaactaaaaggactcagagttcctggaagaaatggctgatattggagatggagcatgaaaatacaagatgagtctggaatgtcttttgtgacagaaattaagttaattctcaaagcataatggggatatgtcaaaagaacatagaagccagcttgaaaaagttcccactggagaagtttggaaaatttgagtatgaaaacaatagcaatagattataacccattgaaaaaattaggatttatttatatataaattgaatataattttattgaatgaaatgaattcagttgattgaatgaaaatgtttttataagaaatggtttttttacttagtgtcaaagtacctcatcataaaataatcactgttacaaagagacaaatgatatattaacaatgtaaagacctggaagatatcacttttatcaagtgatcaaataagtatcatcattagtggggcaaataaaaagtatgtgccctctaacaggatgcaaatagaagaacacaatgtcacttctctgatattattgtcaaagatgtataacctgagtctatttgtgaggaaacatcaaacaaaccaaaattgagatattgtctacaaaataattagcctgtaatcttcaagagtgtcaagatcatgaacctcataatcccggaacaggatctgttccaagtagcaattacatatgggtattccttccagcacttttcaggaagtttatgtttttccaaattttgattctccccaaaagtcagttgagaaatttggaaagtgggagcaaattagcaatcaacatagaaatgttactggtttgaaggaatctgctgatgttacattcaaagcaagaacagaaaactttgacgcatagagtcaaaggttgaggtcaacatttccaggaagaggtccaggggcttataagagagaaagtcatgatttaattagttaaccttgattatagctgttacatgttgtatgtttatgtccatggtcttgtctgctgctaacagtgagtcattctaccaatgagatcaatagtaggcagggtgctgtggcttacgcttgtaatcccaacactttgggaggctgaggtgggaggattgcttgagcccaggagttcaagaccagcctggccaaaatagtgagaccctatctgtacaaaaaacaaaacaaacaaacaaaaaaacattaactgggcacagtgacgcacgcctgtagtcccagctacttgggacgctgaggtggcaggattgcttgagcctgggaggccaaggctgcaatgagcagtagtggcaccaccacactccagcctgggtgacagagcaagactctgtctcaaaaacaaacaaccaaccaacccacaaaagataaatagtaatacgtttatatgcatagtatactttatatagatcctgagtggtgttccaagaaataacaagcctcagaagtgaaataggcccttatattggcagttttgtcatgtgattctgtgtggtgttgtttaaccttgcttaggagatccaaatgtttaaatattacccaacaatgtttcctgatcttatacatgttgtgtgttgcaatgttcactgtaaggtacagttatttgtaaagcagacaaaatagtttcatcattaaaaaacaaaataaacttctatgagccagcatgtgcccgaaagctcaagtaaagatgctttggatgcactcttaatctgaccaacatcaacacagaatgaattttttttttctttttttttgagatggagtcttgctctgtcacccaggctgcagtgcagtggcacaatctcggctcactgcaacctccgcctcccggtttcaagcgattctcctgcttcagcctcctgagtagctgggattacaggcacacaccaccacgcctggctaatttttgtatttttagtagaggcgaggtttcaccatgttagtcaagctggtctcgaactcctgacctcaggtgatccacccacctcggcctcccaaagtgctgggattacaggtgtgatccaccatgcccggctgattttcttttttcttaaataaaaagtaaaggcacttcttcctgaatgacaggagggaagacagacagagtcaatttctcgtctgttgttggtaataggaaaaacctgctaacaatcctgtattaggcctggttccctagaagcagaagcagagacaggattttgtgtgagtcctttactgagggagtcctctccggagaaagggattgaagaaagcaggataatgaatggcagaaaagtccagcaaggttggattggtgagcagcaagggagcttggctgaggctataaaacatggcttcttagtatcccagcacccatttgatccacacatcaaggttaacttttgtagctgaggaagttgttttatggtcaataattttgtacgttattagtaccttggggtaactttgtatccttccctacctgaccatatatcatcatgtatgcatggtagtgttccagaataacctattatttagttcacatttgcacagatttcaagttacttgtgcatgctaaagaacattgagattgcatttctttttaaattttattttaaattgacatataattgtacatatttatgcggtacagtgtgatgtttcaatacatgtatactttgtgtaatgatcaaatcaaagtaattagcatatccattacctcaaacatttatataggaaatttcccttggggtatctgttctcttagtttcaatcatcaccttgatgttgttaactcccaagtctttgccaatcaatcttcatctcatctggcctatccagcatcatttttgtatctggcccactatgccacaatgattcatgcatagtaggtgttcataaatgtcactcacacttcggtcaagctggtctctttatcacaaatgaggtattgtgaaattgaacacatgatttggaccttaactttaaaaacaacaacaacaacaacactaactgggcaagttagccttttgcagctttcagtttccttatctacactaggagtgataatgccatagcataggaatgtaggaaaaattaaaggaaataattcattttaagcacatagcccagtgcctagaaattgacatgtacctggtaaatgttggttctttctcctttttgctgaatatttaaggcctgctttttaggcctcttacttgatttatcctatttgttttttaccacattcatcactcttagttctgacaacctaggaaaagaagtttctttaaagagttggaaagtttaaaacaaataatatttgtgtaattcagtagaacttttctgggtatgatttttgactaagattttctttaagaaatagggagggtgggcctacataaagttggccataatgcttttaaaaactaaataaatcagtatactaatattttttaagtaaaatttacaatctgaaaaattacacttgggatgaagaacatttttcatctttaatattaaattcttaagaacagcattgaatggcacactatgtttcttttccccatgtcagtcatctagtatttctgtgcatatacactgtattaagacgtctgggagagtcagaagaataagataattttttttccccattctcaaatggccagcacatttctcaatactgatgtctagtttttatttcagttgattacttgtgaactactgttatgtttgtacacatgccctcatttggttttatactcatttgaatggttctcaaatattgccatcaactacatggtaatgctagaggtacattatatctagagggtaactgaatatatttagtttgcatgaatatattcatgcaagagcatgaaagaagacataagactaagtgccaacccaaaaggtgaagattacccagatgtccatcagctgatgaatagataaacaaaatgtggtctatccatacagtgaaataatattcagccataaaaattgatgaagtgctgatacatgctgtaacatggatggatgttgaaaatattacgctaagtgaaagaaaccagacacaaagtgtcacatattgtgtgatttcatttatatgaaatatccagaatcagcaaatctatagagacaaaaagtataatagaggttaccagggcctgggggatggggagttactgtttgttgggtacagaatttctgtttgggatgatgaaatagttctggaaatggatagtcgtgatagttgcacatagtaagtgtactcaatgctactgaattgtatacttcaaaatggttcaaatggcaaatgttacgtgtaagggacttgaagatcattgttataagcctcctatttttctttctgcacaggtgccatggataacagaggctttcagcaggggagttttagtagcttccagaacagctccagtgatgaagacctgatggacattccagcaaccgctatggatttctccatgagagatgatgttcctcccttagaccgagaagtaggaggtatcattattggtgatgataatttatcttaattttttaaaatttatgtacaataaaattttatttttttttaattttattttctagcacacagtcctgtgagtttttaacaaatggctagattattgtaactaccaccactgacaggatacagaacagttcaactccctaaagaattccctcttgccactcctttgcagtcagacctccttcctccctaacccctggtaccagtgatcttttctctgtccttatagtttcttttcttttcaatgatgtcatgtacatggaatcacatagtatgtcactccttgagactgctttcactcagattaatgccttggagatatatctaagttgttcatttcttcttcttgctgagtagtatacccaggagtaggatcacttagtcatatggtaaatgtgtttaactttataagaaactgacaaaccagagtgccggtaccattttgcatctgaactagctatgtatgagagttctacttgctctgcacccttaacagcacttggtattttggccatcctagtataatacgtatgtagtgttatctcatcattgtctcaatttaatttccttaatggctaatgacgttgaatagcatttcatgtgcatatctgcccaccttatatactgtttgatgaagtatatgttgaaatcgtttcctctttctataattggattttttattaactggaatgcattcgtaaaattaaaatccccctccttggttatctggttacctagctgcatattcttttcaatggctgcatacaatttcatggtatgtttgtgccatggcttatttaaccaagcttctattgatgcacatttcagtttttctgatcttttgctgttacaaacaatgctgcaacaaacaaccttgcatctatgtcttctaggcatatgagagtatttttgtcgcataagtgtatgagaatgcctatttccccacaatcttagcagtgctgacattaccattcttttttcatctttacaatatgataggataaataaatctcattttaattttcatttatttaattaatgaggttgagcatatttttatatgtttacaaaccgtttcagtttctttctctgaaagtttcctgttcatgtgatgttcctatttttctaataggctgattatttgtttttatttctttaccagagcccttcatatactattattactcttttgtctgatgtaggttaaatgtattttatccacttctagtttgtctcttttaacttttttttaaatttacagatatttaaaatgtttatatagccatgtatattgcccctttcctttatgacttctgaattccttattgtacttagaaaggacagtatcactttaagattacatttgtataattactttaaaactctgtctggttctttaactgggattgccattgtaaaagtagacagaggacaaggaactgctgtcaaattcattatgcagcaaattcatattaagtacataagacattgtagacactttgctgagctctgggaattagcaaggcttgaagataccatccctgccttcatgaagttgattatagctagctaaatagccacataaatacttatgatagttcctaccccttagagttattttcaggattaaatgagataatacatatatagtgcttataactatacctggcatacagttaagtgctcaataacatgttcagtatcattattttattattattattgctacaaccctgtattataagttctatagcttttataggaatttagcagaataagcatttcatgtgtgggtgtgtttctgcgaaggactggagatttcatagaaaagatgttttggagcgaggtcttgaaagattagttatttggtaggaagaacacttcaggcagaaagtatgcttttacagagatatcaacaggcagaatatatggagatataaaaaggcagaatgtaagtccagatagttggtgttatgtgcatccgtataagagatcacctgagcaggcttagtgtgagcagcaaggctgtttattcacttgggtgcaagtgggctgagtccgagaaaggagtcagtgaagggtggtgggattatcattggttcttataggtttgggataggcggtggagtcaggagcaattttttgcgggcaggggatggatgttacaaagtacattctcaagagcagggaggatgttacaaagtacattcacaaggatggggaatatcacaaagtacattatcacaagggcaggggaatgtcacaatggcttgaccattgtgcggccacctcaaaggatcttacagtcgggccttgaatgtcatgctaataagttttaattaaccttattgtcactgtaaggatgaaactccttcatcaattcattcaacaaatagttttagagcacctgctgtgaaccaggctctattgtaggcactggggatacagtggtgggattaagacaaatattgacctagaacttagagctagctggggagggcagtaaacgagtaaaaagattacttagttaattacccatcatgataagtactaggatggaaataaactgaatgacaatagattataactggggaataatactttagttaggaaggtcagggaaggtttctctgaggaggtgactaatttggggtgaacataccagtataaaagccacaggttaaaaagaataacaaggaatttgccttgggaagatatgtcaggaaagggacagtaggagagggcccctgaatttaaagttcataaaggaagggtactcatggtatagtagttagtggtcatctgcctacttctaccaaagagaactgtgttagcatattgcttctgcttatgtgtagttataaccatactgagtcagttacaccaatcactgactttagtgaagtggtcagttagggggattcataagcttacattggctacctctacttaaagtcttctggttaaaccagagtggttaatcattgttacttctaatagaaaatggtatccatcatctataactgcaaagtactttgtgtgttcatgttgctctcagtagatgattggggcaagtgactatgtattattctcatttcatagactagaaaactgaagcagaatgagattttgacattacctatgattgtagaatgtgttttcacatgaatagtccttcatcacttttcattagcctttacaggagaactactgcttctagtttacaaggtctaaccataaaataatgaggctgcttttcatgagacaaacacgaaaatcagcccacttatagcccactctgtagtgatataactttcttgctttgctttctaattgctcttactttatttaatgttttcacatgggatttcctaataaagacaacgacaacaaaaaggtcacaatgtccttgatattcagaggtgaaactgcataaaatactacattttgtaccaggcacaatagcacgtactaaaaagattagtgagaaggggcttgaaaggcaataaaagtggttcttgttttccagatggctagagggcttgatttatgaggaatgaataaataaattatgcatggcatggttaaatgcatctgaggtagtgttatagtagtttgtaaattagaagaaacataaacatagagatgtgaaagaaggtggagggaatagaaaaagagtttgagtaacagaaaaacacggaggactgttctcatagtccatctgttctcacttgcctgcctctgcagcctgcaccttatggtcagcagtgcattcattcattcattcattcacttactcatttgatacttatggaacacccagatatgagcctagcactgtgctgttttagtaatgctcttcgattccccttttttcctcacctccctgtctttctacctagtgtgccttgctactccctaactgttgaatgaagagacattcctggcagggagagcaacacagataaaggtccagcagcatgagagagccttttatattcaagaaacagagtctgtgggtttgaggtctgaggccccctggggtgggaagggtggtggcagttggagcaagaaggaagactgcaggggctagggtaggaggagatctagttagaaatctaggtggggtccagattgtgtacacttttcgacctcatttgtaaccaaagcaccatcaaatgaactaaaagcagaggaatgatatgatcacatttgagttttagagaatttttggcagtgtggagggtggcttgagtagtgtaggttggagacgagaagaccagtgagtgaaacttgtttttttgtaatctaggcaaaagatcaaaaggcctgaatgaagacagcaggaatgtagaggaagaaataagttctggacaaatttcagagggggaactgataggaccaattagatatgggaaataaaatagaaaagagtcagggatgacttcaaagcctaagcatattattgggtaggctgtgttcccccatactgcctgctgagtttcaacataacctaccaaaatccaggagaagaaaaaaaatcttaatactcaaatgtgatagaataaaaaacctgagggtacttgaaatttgccaagtaaattgcaaaacatttctatttgttttgccacactgtaaaaatatgtcatagtttttctccagagagaaactgaaaacaaagtaaaatatcttgggttccagctcatggagaaatctactattatcacttcagttaggcttccctcaagctatctgactagagcaactgtgtggattgtgtgggaacgaaaagaaaaggtattttgaaattaatcattcttataacacttgaacgtccctaaacacttagcctggaagaatggcaaacattactgttgccttttgaacttaaaaaaaaagtggcccatatggaaagctctgcagggctataaaccacatcaatgtaatatgctggatctttaaaatgaaacctatgatgatgtccacaggctttaaagggttcatttaggttacttaattaggaaaacggccaaattttagaattgatgtcctctaatttttcccccacttactttttttttaattagctaaagtacataatttcttcagatttacttagtttttacctaagtgtctcatccaggatactatattacatattcttcatgtctctaaggagctaagggctcctcttggctgtgacagtttctcagactttccttgtttttgatgaccttaacagttttgaagagtactggtcaggtattttgtagaatgtctctcaattgggatttgtctgatgtttttctcaagattacaatggaattttggagatgaagaccgcagaggtggagtgtctttctcattatgtcttattaaggagcacatactatcaatatgacttatcactgttgatgttgaccttgatcacctggctgaggtgtaatgtttgccaggtttatccactgtaaaactattttttcttctttccatactgtactcttcggaaggaagtcactgcgtagaacagcggtccacaacatttttggcaccagggacagggaccagtttcatggaagacaatttcatcttcaacgaaaccggcggtggggggtgaggatggttttgagatgaaactgttccacctcagatcatcaggcattagttagattctcataaggagtgcacaacctacatccctcgcatgcgcagttcacaaataaggttcgtgctcctctgagaatctaatgccgccactgatctgacaggaggtggagctcaggctgtaatgcttgctcgccctctgctcacctcctgctacgcggactggttcctaacaggccacagactggtatcagtccatggccccgtggatggggaccccctggtttagctcacacgtaggactaggaagttaggtttcacctccatgagggtgaaatatctacagaaattatttggaattgttttacatgggagatttgtctttttctttcccatttatttatctattaaatcatttatatcagtatggactcatttattttgtgctttgagttataatccattactacattttgttggtcaaattgttccagctttggctactgggaactctttcaattgactccatttccctttgacaaactcctatcattgtggggtcttttttgagcatatccttattttttggcactacaacatgctctaggctcatattatatatttcctgccccagtgctagaatcagccatttctccaaggaaccctggttccttttattggaaaatggtattagaagccatgatatggatacatggatactaggtatgctcctttctactgaggcatttgttgcttctaggccctgttagccaatgcagtaaggaaatatgtgtattctgacccatacatatatacacacatatacatatatctatgaatatatgtatatgtaaccacctgtatctacggtaagctaaacatgagatcatactcatgtctctaattctaatctattaccacatggatcactctagcctcctccctttgcttgtctataacctcctactccaacagtgagaaacctggttcctaccactcacaatctgttacttaactgtttacttctggtatgtagtcatatgctacataatgacattttggtcaactacagactgcatatatgataccacgttttaatagtttgtggtataaatagtaccaaatttttactgtacttttctatgtttagacacatacttaccattatgttacagttgactacagtattcagtagaataacatgctgtacaggtttgtagcctaagagcaataggctataccatacagtctaggtgtgtagtaggctagaccatctaggtttatgtaagtacactctatgatgtttgcacgatgatgaaattacctaacaacacatttctcagaatgtatccccatcattaagtaatgcatgactgtacatgtatagtggtttcagaattgttaacccataccctccataagagacaactttatcaagagtgcagcatcattccttttgctttaatcttacaaattttattcattttcacagttacctgggtcagcacttttcacctttatccctttcattgaggctgttttataaatttgtgatgcagttagattcttttttcacatgctgcattctatcctgggatcttcagtctcctaaatgatttttttaatttgcatacattatgttcattctttgtgctgtgaagttctataagttttgacaaatatatagtgtatccactattacagtatcatgtagaatagtttcactgccttaacaagtcccctgtgcattacctattcaatcccttcttctcttgagtccatggcaaccactgacctgtttattgtctccataaatttgcctttaccataatatcatgtaaaaggaatcatacagaatataacctttttagattagcttctttcacttaccaatatgcatttaagattcatccatgtctttgtgtggatttattgctcattccttcttattgctgaatagtattccattgtctgtatatactactgtttgtttatccattcatctactgaaggacatcttggttgcttactgttgggggcaattatgaatgaagttgctacaaacacctgtgtgcaggtttttatgtggatataaattttcaaatcaagtaagtaagtatttaggggtgcgattgttggatcatatggtaacactatgttttgttttgttttgtttcataaaaaaaagtgccaccaaactgtctgccaaagtgccaaagtggctataccattttgcattcctaccagctatgaatgagagttcctgttagtttgcatccttggtattgtcagtgttttggattttagccattctaataggtatgtagtggtatctcattgttttaatttgcatttctctaatgacaaatgatgttgaacatcttttcacgtgctatttgccatatgtacatctttctttggtgaggttcaggttttttgcccatttttaaattgggattttttttattgttgagttttagttctttgtattttggataccagtcctttatcagatatatattttgtaaatgtcttatcctagtctgtggcttgtcttcttggcttttttttttttttttttttgagatggagtctcgctctgttgactaggctggagtgcagtggttccatctcgcttggctcactgcaagctccgcctcctgggttcacgccattctcctgcctcagcctcctgagtagctgggactacaggtgcctgccaccacgcctggctaattttttgtattttagtagagacgaggtttcaccatgttagccaggatggtctccatctcctgacctcgtgatccgcccacctcggcctcccaaagtgcggggattacaggcgtgagccactgcgcctggccgtggcttgtctttttatactctttacagtagtttttgcaaaccagaaatttttaattttagtgaagtctaacttattaattttttttctttcctggatcatgctatttgtattgtatataaaaagtcatcactgaatccaaaatcatgtagattttctcctatgatatcttccagaagttttatagttttgcattttacatttaggtcaatggtacattttgtgtaaatttttataaaaggaggaaagtctttgtttagattatctttttaacatacttatgcctagtcattgcagcactggttgttaaaaacactgtcctttctccactgatttgcctttgcgccttctttaaagattaattgactgtatttgtgtgggtctattttggggctctctattctgttctcttcgtctatgcatcttttcttttgacaataccatgctgtcctgattactatggctttatggtaaatcttgaaatgaggtagtgtgagccttccaactgttcagcttcaacattgtgttggatactctagatgttttgcttttccacagaagctttagaatcagtttattgtagctgcaaaatgacttgcttgggtttctgttgggattgtgttgaatctatagatcaagctgggaagaattgaaatctcaataatactgagttttacatcccatgaacattgactatttattcagatctttagtttctttaatcagtattttgtagttttctgcatatagatcttgtatatattttcttagatttcgacctctaagtatttaatttggagtggggtggggtgactattgtaaatagtattgctttttaaaatttgcaattctagttcattactggtataaggaaagcaattgacttttgtatattgactttatatcctggagtcttactatgttgtctttattagttctaagaggttgggttttttccccttcaggatttttttaggattctttgggattttctacatagacagttatgtcatctgcaaataaagacagttttatttctctctttccaacctgtatactttttattaccttttgttgtcttactttactagctaagatgttgaatagatgaatggtaagagaagacatccttgccttgttcctgctcttaggggaaaagagtctagtttctcactattaactgtgatattagctgtagggccttttttggtagatgttctttattaagttgaggaaattatactttattcctactttgctgagagttaatcatgaatggatattaaattatgaattatgtcaaatgcttttttgttgtcaatggatatcatatgacttttcttctttagcctattgttatgctagattacattgatttttgaaatgttgctccagctttgcatacctggaataaattccacttggttgggattccacttggttggagataactgatattatgcaatgtcgaattcaattttctaatattttaaaaggatttttacatctatgttcatgaaaggtattaatctgtagttttcctttcttgtaatgtctctgtttggttttcatatcgtttaatgttggcctcatagcgtaacttaggaagtgttctctccgctacagttttctggaagagattggggaaaattggtataattttatccttaaatgtttggtagaacttaccagtgaaaccatgggggcctggtgctttctttttggcaaggttattaatttttgattcaataataataatagggaatacatttaagttctgcaggtctattttacaacacgatgatagttaataataaggtattgtatgcctgaaaattgctaagtgaatgtattttaaatgttctcaccacaaaaaataagcatgtgagataatgaatgtatttagtttgatttaataatttacagtgtatacgtatataaaaacgtgtacaccttatttgtcagttgtaccttcatagaggtggaggaaaaatagaagtgggttgtttaagctttgtgtattttgggatttctagctctctttgtttaattaattaatctctagtttaattccagtttggtaagagagcaaactttgtatgatttttaatctttttaaagtgtgttttgtggcccaggatgtggtgtatcttacaaaatatgtgtaaacttgagaagactgtgtattctgctgttgttggatgaagaagttgataaatgtcaattatattcagttaatcagtgaaaaaataataataatagatgtggggctcttcagatttttctgtttctcctgtgtaagttttggtagtttgtgtctttcaagtagttggtccatttcacctgttagtaaatttgtgttcatagtatttctttattatccttttaatgtctgagagaccgggagtcatgacatcttcttcatttctgatatggtaatttgtgtctccgctcttttttttcttggttagcttggatagtagtctatcaattttgttgatccttccaaagaacctgcttttgttgatttttctctattttttcaattttattgatttctgttctaaatttcttattgtctttggtttgctttaggcttatattgttctcttcttctcctagttccctaagatggaagcttaggttattgattttagatcttctttcctaatatatacatttaagcctataaatttccctctaagcactgattttgctgcatccctcaatgttacttctcacatatattatattttcatttatttcaaaatattttaaaatttgtcttgagacattttgacttacaagttatttggaaatatgttgtttaatttccaggtatttgaggattttccagctatttttctgttattggcttctattaatagctcaattccattgtgttaggatttacagcaaactggctaggacttgggctgtatttcatgtttggtgtatctaggtgccagaggcttcaaattcctctagtgtgcttgtttttgtctctcctcttgattgtgagtttccctgaggacaactcctctagagagtctgtgtcttgcagctctttcaactgtgatccactattattatactggagccctgatgaggtggtggtgaagtatgggggaggtggtaattttataatcctctgattaaatgtcactgtttgatggaactgtgttttgtggctgtgaccttcatacatttttctccagtagtatactttttgtcctccctgccctctactctcttctttgactgcagcattcccaatgtgtttacttgaagccctgcaccttgttgagtatgttcccctgctttaggtgagataagaaggctagatgggatgggagtgggaggaatgtccttctcccaactgggataaggctcaggcaaagtattttcccctgaggcctttgttatggagaaatatctggcaagtttcacaatgatttctctttccctccccttgtcagagccaggagggattcttagatcttcactgtgagaacttggtggggttcctggatgtagagctttggtgtgggagctcccctaagaccgtggtccccaagagtttcttgtactcacgccagtccacactcagccttcagcagcttgttcaagttgccatttgtgtttctaccagctccagccatttctactccaggtaagcagatctcagctgtgtctctttgaataagcttctctcttcagattttggggtggcagtttcctctgcaacctcagttctccaatgagtccaagaaagatcattgattttttttggtttatccaaccttttcttgtaagggtgagagcaataacttctaagttctttgcttgcaggagctgaatccagaggttccccattttcatttaataaaaccactttggtcctttcttgaaggaaatatactttcggctccactttgttccaattcatgacacgtggtagaggaagcagttgctgtaatgcttcagggggtatgtgccatatgtttctaagatctggggctaacaggtaatccagagatactgtagccgtatgagtatagctctgtgtagttaaccacatgccagaaatgttgggtctcagtgagatactagattgtcctgtacctcactgatgagcttttctaaggattggtagcaccattttatgatcttgccagtagaacattctcagttagctatgcaatcaaaatatcatttggaattcttcaaagataagggcctctcagaagtcattcaatccaatatatgagtgaccaaacaaaaaatcatcgctaaaatgatacagtatgaatttggaagggaccttaacattatatttactaatacaccttcatgttacagatggaaaacctgtaaacccacagagattaaggcagttgcccaaggtgacacaactagtgagttatggagctaggattggaatccacatcttctcactgcaggataataggtctgatcacactttgttcttatttaaaaactgaataagcgttcttcctctcagggctttccctcttagtgttgaccagaaactatcacctactttgtccacaagtatcccagtaatctgcctcccagaacataagtctgctccttgcaatgtcctgtctctgttcttccagttgcattgctagtattttttcttttcaaaatcacttacataacacataaatatgtctcactataaaagattcaaacaatacacaggtttttaaaatgtgaaagtctcccttgttcttcccactccagagacaaccaccaaaaagaattcagtatgatccttccagttctttctctatccagtcacatatacagacacacatttaaaaaaagacatattctgcttattttgtgacttgcttttttcatataatatgtctgggatacatttctatttcagtacacatcagtctacttctttgcttgcactatttccctattactagatactttcattgtttctgggtttttgctactacaaacagtgctgcaatgaataacacacatacattggtgtgcacaggtgcaactgtgtctttaattcccacatgagatatatatatatagatatatatatatatgcttttttgaaacttatttttctgtccatgacatcacacaattcctatgaatccaaggagaatctcacaattggtattttctgtcttgaaattttccccccactaaagaataattgctagtcttgtgtgcccagtttccttctggaaattaatagaaaccaatgtagacttaggacagaagaactggagaattgctgcttctaaaacaacaattagaagttattaggcaggatcgtgctacccaaaggatttcccaacactgtggtatgtaatatgcattttagggcagtgtctccctacccatcacattccccattctcttgtcagtcccataaatgtgtacaattgagaaggaaggaatgaagaacaagtaagggagtggggcgctgtttactttttgtggggagccctctcagcaactttgtcaaatctagcccctttacttcattgccacattgctttctgtggcatcttagtccagtgggagcctgcagataccaagccaaagtcctcatgctgttttggttactttgataactctgtcagttagcaccctggttccactggtcatgaaagtgagttgagtcaggaacttccagatttgagcagatgctgggaataagaggactacaagagatacaccccaagaaaatagccacaacccagtaaagatggagctgtatccactgggagtaaagagtcagaaggaggtgttagaatctgaattcatgcttgtctccacagctttccctatgcctttctgccatgcccaaccttcctgtttttttctcataactctcaaacttcatttcaatatcatagatttgttggagttcttgcagttccatttcccacatccttcaccaccccttttattgtctagctctcagcagagtcgggatagagtttcttctttgttgtccttcctgcgtgttagacaccttcaagttttaacctgctgtgaacaggaaccaaagcagtggatcactaaatgaaatgagtgcagggatgagattcaaaacaatgcaggcactgcccagtgatattggctgtcagacatagcactggggcagtgtcctggagcctcctggtattccagccgctggatcatgggtaagttcaggagtttctagggtagggtgaggtgggggaggagagtcctgaggaaaaagtggttatttatctgtagctactgaagtatttcagtatttagcaaactggtatggcatacagatgcatatcaacagaatagctgccctgaataagtgtcccaggggtcaaactaagagtacactaaagcataatgtggtcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagatactatccaggactctcctggatagtttcttagatgggagggctactccaactacatttgcttcttggccactggacttaattgagtgggaaaacaaaatagaagcaaaatgaaggcacaagttgctagatagaaagttcctacaaatgttgattaattatcagggcttccgctgtaatgtactatcagacaaataggtgaaatgggatgtgaaagagtttatgtgacttattggcagatctagaatggatgaaccagtacaagaagggaagcaggatgcgggtatggaagtaagaagtggcatataataggctcttagtatttgctgttgaatgcaagtaaagtttaaatgaccacaggatgaatatctgctgatgtgtgttaggcataatgttgaattttttgtacatttggttccagccttgcaaaaatacaatatatcgctgtaaaactgaaatacattttttaaagggactattttcaagtcctgtgatatataccaatagccctgccccatttctttgaatgcttatttatttctttaggttgttgccaattagtgagccctaatgcagctgtgatattactaaagcagtacttcagggtctgtgcatgagatttcttcctattctttttcctcttgtgtttttgttagtgtttaactagttcacttaatcagttactgttcagccccctaggtaaatttctaatggcatattggttagggatttaaataaacattattctcaacagattttttttttcttgtattttaaggggttttccagtttaaagcatcatgtgatttttagaaaaaaaaattagacagtgatttccataatgagaactgagttaaatacattcatttatatgcctcctcattcaagcagtgtgtttctagagacctgttgttaagtctttagatccgagtataaccctaacgggaaagctgtttcaatgttgacttttttctctgactggtttactgtatgtttttcctggactcaggcaatgcaaattagccttttgggggctttttgttctatcattcaagttgagatctaattgtactttaacttgaataatttttgttagaacattaagttattttatatataacattcactatgccttcaaaatttgagataagttttacttttttttttcttatagagacaaaaatctagactcacctaagtaccccaacctgatgtgtaggctcattgtttaatttttctctgccttccttggcagcatatttacatgccagaagcttagctcttaatgcattgtttttttgaaaagccttttgcattttgttactttgtgcatcattagttaatgggtagatcatttctgttgccattcttgacagttaatttttaaaaatttattttctttctattaagttttaaaaatgctaagaaaagaaaccagctagatgtggaatatgaccaatgacttaagctgtttgtcatcaagtcagctatagatatcttgatgaaagtgtgtgaacaagttaaaccttttcactgatgaaacctaaaatagtagcaatggctgtcatcatcatcattgttatacattttaaaatatattgtttttcttattctaaaaatatgatgaatatttttaaattcacagtccacacttgtgtcagttaaccatttagaggtcttcatgtgctaaaagttttcaaaatattgctgtaggggccactggcattgtaaaaattgggaaatgatctggtcagatcagtgtttcagaaagaattctgcttatctcaaaatagtctattattgtgtttttatcataggatgcattaaaagttggtaagaatttctttatcttattttcacaataatatcaattgacctacactgggcagtctgtataatgaacacacactaaagatggtaagtttgccagagaaggaatggagagtagaaaagaataaaagaaataaagcatgtcaaactctgatactggtgcctcatttcttaatctaaattgtcattaaatcttgttttagtatgaggactgaatcatagccaccagccctctagttctcaaaggaagtaactgtacatggaataaaaaaaaaagtcccttccttggaagtgctgataaagcatttgaaaaacacatgaactttcattaaaagtcaataacgtggcaccagctatgcaatccataggaactatatatttttatgtaccaaaaaagatagtatctttgctaaatcgactgctaaatactatagctgctaaagtgtgaaataatcttatagataatgtaaatcatactagataatataagtgaattctttagtggtcttcagatactgttacaggtaaaattgtgtttactaacgaacaacttggaaggaggctttagaggttaggcacattaccctctttgaatgagatagacatacttttctaaaagtttaatggaataagacagtcacggggggaggagccaagatggccgaataggaacagctccggtctacagctcccagcgtgagcgacgcagaagacgggtgatttctgcatttccatctgaggtaccgggttcatctcactagggagtgccagagagtgggcgcaggccagtgggtgcgcgcaccgtgcgcgagctgaagcagggcgaggcattgcctcacctgggaagcgcaaggggtcagggagttccctttccgagtcaaagaaaggggtgacggacgcacctggaaaatcgggtcactcccacccgaatattgcgcttttcagaccggcttaaaaaacggcgcaccacgagactatatcccacacctggctcggagggtcctacgcccacggaatctcgctgattgctagcacagcagtctgagatcaaactgcaaggcggcagcgaggctgggggaggggcgcccgccattgcccaggcttgcttaggtaaacaaagcagcggggaagctcgaactgggtggagcccaccacagctcaaggaggcctgcctgcctctgtaggctccacctttgggggcagggcacagacaaacaaaaagatagcagtaacctctgcagacttaaatgtccctgtctgacagccttgaagagagcagtggttctcccagcacacagctggagatctgagaacgggcagactgcctcctcaagtgggtccctgacccctgacccccgagcagcctaactgggaggcaccccccagcaggggcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaatggaacaaagctggatggagaatgattttgacgagctgagagaagaaggcttcagacgatcaaattactctgagctacgggaggacattcaaaccaaaggcaaagaagttgaaaactttaaaaaaaatttagaagaatgtataactagaataaccaatacagagaagtgcttaaaggagctgatggagctgaaaaccaaggctcgagaactacgtgaagaatgcagaagcctcgggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagcaaggcaggccaacgttcagattcaggaaatacagagaacgccacaaagacactcctcgagaagagcaactccaagacacataattgtcagattcaccaaagttgaaatgaaggaaaaaatgttaagggcagccagagagaaaggtcgggttaccctcaaagggaagcccatcagactaacagcagatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgaccgattttgtcaccaccaggcctgccctaaaagagctcctgaaggaagcgctaaacatggaaaggaacaaccggtaccagctgctgcaaaatcatgccaaaatgtaaagaccatcgagactaggaagaaagtgcatcaactaatgagcaaaataacgagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaactgaactcagctctgcaccaagcggacctaatagacatctacagaacactccaccccaaatcaacagaatatacatttttttcagcaccacaccacacctattccaaaattgaccacatactgggaagtaaagctctcctcagcaaatgtaaaagagcagaaattataacaaactatctctcagaccacagtgcaatcaaactagaactcaggattaagaatctcactcaaagccgctcaactacatggaaactgaacaacctgctcctgaatgactactgggtaaataacgaaatgaaggcagaaataaagatgttctttgaaaccaaagagaacaaagacacaacataccagaatctctgggacgcattcaaagcagtgtgtagagggaaatttatagcactaaatgcgcacaagagaaagcaggaaagatctaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaacaaatggatgcattcctcgacacatacactctcccaagactaaaccaggaagaagttgagtctctgaatagaccaataacaggagctgaaattgtggcaataatcaatagtttaccaaccaaaaagagtccaggaccagatggattcacagccgaattctcccagaggtacaaggaggaactggtaccattccttctgaaactattccaatcaatagaaaaagagggaatcctccctaactcattttatgaggccagcatcattctgataccaaagccaggcagagacacaaccaaaaaagagaattttagaccaatatccttgatgaacatcgatgcaaaaatcctcaataaaatactggcaaaccgaatccagcagcacatcaaaaagcttatccaccatgatcaagtgggcgtcatccctgggatgcaaggctggttcagtatacgcaaatcaataaatgtaatccagcatataaacagagccaaagacaaaaaccatatgattatctcaatagatgcagaaaaagcctttgacaaaattcaacaacccttcatgctaaaaactctcaataaattaggtattgatgggacgtatgtcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggagataaagggtgttcaattaggaaaagaggaagtcaaattgtccctgtttgcagatgacatgattgtatatctataaaaccccgtcgtctcagcccaaaatctccttaagctgataagcaacttcagcaaagtctcaggatacaaaatcaatgtacaaaaatcacaagcattcctatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggccatactgccccaggtaatttacagattcaatgccatccccatcaagctaccaatgactttcttcacagaattggaaaaaactactttcaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacgccgcttacctacaactatctgatctttgacaaacctgacaaaaacaagcaatggggaaaggattccctatttaataaatggtgctgggaaaactggctagccatatgtagaaagctgaaactggatcccttccttatgccttatacaaaaattaattcaagatggattaaagatttaaacattagacctaaaaccataaaaaccctagaagaaaacctaggcattaccattcaggacataggcatgggcaaggacttcatgtccaaaacaccaaaagcaatggcaacaaaagccaaaattgacaaatgggatctaattaaactaaagagcttccgcacagcaaaagaaactaccatcagagtgaacaggcaacctacaacatgggagaaaattttcgcaacctactcatctgacaaagggctaatagccagaatctacaatgaactcaaacaaatttacaagaaaaaaacaaacaaccccatcaaaaagtgggcgaaggacatgaacagacacttctcaaaagaagacatttatgcagccaaaaaacacatgaagaaatgctcatcatcactggccatcagagaaatgcaaatcaaaaccactatgagatatcatctcacaccagttagaatggcaatcatgaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacacgtatgttcattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaacaacaaaaaaccaaacaccgcatattctcactcataggtgggaattgaacaatgagatcacatggacacaggaaggggaatatcacactctggggactgtggtggggaggggggagggggaagggatagcattgggagatatacctaatgctagatgatgagttagtgggtgcagcgcaccagcatggcacatgtatacacatgtaactaacctgcacattgtgcacatgtaccctaaaacttaaagtataattaaaaaaaaaaaaaaagaaagaaagagaaattccagagcaaaaaaaaaaaaaagacagtcacagttgggccacaaatggcttttgctttttcagcaatgtagctcatggccacttaatacagtcagttgccacttcattttcaatcctcctccttaatgctagattagttcatcaagtgagtgagataatataacaatgatgaactgaaagcatacaggtcccatgcagtgcctcacatttcataaggttttgttgtattaacatttcagggtgtatcgaaccttaagaattgatgcaagtaatactatttcaaagctctacacatagggtccagttattacagcacactgtgactgggttaatgtttaacagtggctgtcctttgggttcccttagggaatcctcccaatttagggagttgggagatagcaattttatttttctttaccggactgaccttattgcacaattaattaagacctgctttaaaatagccttcacaaccctttaaaaccatggaaacatcatagtgaatttattgtcaggctaaaatagctactttcatccaggttggattaatgagtaccagagttgttgttgctttctgcgtagagcattactactcagaaacaactcattttcttgactatactctgggttttcaaagtgatgaggtgctgttaaagaactgaccttgtatagtaagttcatatgaagtttagtttttcacgttttcctttaattatgatttgtacataagcataaaacatgtgtacagtttaaagaataattattaagtgaacactcaggtaaaccacctcccagatcaagaaaaatgaccagcattccagaagccctgcccttgccatgtgcccctcccacatggcagccctctactctgggtagcttctgtctttacttttgccatttccttgcttctctttgaaatgtaatcacttacatttgtattctaaaatgatataacttgcttgcctgtttttgaacttagaggcatagaatcgtaatgaatgttttgtgcatttttgtgtctggtatctttcactcagcattaggtttgtgagactacccacgttgctgctatctagtgtattttttaaaaaaccttttttatatttgcctttctcccttttatacttaggacccctgtaactctaaattcttttggatatttctactttgccttcttggactttctgctaaatgaagactaagacttgtctggacccaggtttcctgagctgacccgactgcccgcagtttgatggcatttgtttagatgagactacatctttaaggcttctgtgcccggttaaaaatcttcctttctcccaggctggtccaaaggtctggtcacgtgactccaacagtgacatcacattctgaccgccagggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaaggtaagcagacttgagcctgaccaaggactgaagcatgccccccgggagcaggggatctggagaattgcaagcagtctgttgtaggattctaatcactgcctgctctttgagaggggcctgacaattgcgtttctaaggaaaccagactacaaaggaggatgatgcggtgctcatgttacctagtgatgtaataggattctttctttcctgctagaagctgttgcagatcttcattttgccttaatatccttaaaggtgggggcctcatttgatatatagtgtatcattagatagctatcagatgatttttaaaatcagtttcacaaaatcctatttttccccttctgaaaggagaactcttaaaccagagcaaattcaactggagcattaacctgccttaaaaagtaaatatctggttgtttggtgtcatgtgttcatgtcagcattggacttgagaattgaaacagcttgccctcccccacctccacacacacatactttatcctctttctgccctcatttcctagctggctttttccctctaagctctcaagaaacacatcagctttcatctttatcagtatgacactgacatgataggaaatgctgggctggtgattcagcagccatccattttacagtcaggtacgaatgaagatatggaaaggactttggttggggtttaagattaacttgttcaccttttccactccacccccaccccgcccccaccctacagatgatttggactctgcagagctttttctttcaaatgtgcaccttgcctgtgaaaggcatgctgacttaggtattcagaagacttacaattggtaaaccaattgtaagtacagcttggggtgttccttcaaactttccccatgacattgctaaagttgtctgtttggagtttacagtgaagatggggatgcagatgggaggagagggagtcagctcaggcccactttggcctcctctgcagagggattcattaccaaacagtctggaggaagccttgtccctgccaaggttggtgctgcaaatgtgagctttggctgggtgaattaaatgatggcattactctgcacttttccccagtgtgcatttgcatagattcctcagtactgttttgtattttgtgtttaatagcaaaatcttattccatcagatgatgttgctgaaatattttgaatcaagtttaagccttgtgtgagtatagcttgtgagtttaaaactttctcccccattcccaccgttcatcaaacaaattttggttcagctgatatatactgattcttggatatgtgctagacactgtagagaagggaacgatgaatcagacatcaggctaccagcaaagagcttgtagtctagaaaggaagataaagcatgcacaaaagtaattgtaatagaagtacccaaagcaaagtagataagggactatgatgggtgggcaggtggatatgtttcttgcagttgaaggatcagggagggacatttcatcactgaatcatacactgttctttaaatctctgcttgtaaatcttagactgtgctgacatacttagagttcctacaagcctgttacatcagagatcaagtcttatacctattgaagggaaatttgtacattccagccaacttaactcgtgaagaggcccacatgctttatttggagtccccagccaggcaaaaaccacttcataggattgaattattgccttataaatgtaaaatggttcttgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccaggtgactgtatttctttatcaaccccaactgtagtcatctgatagtttaagggcccgccttttggaaccaaaaagaatgtattaaaaatgttaagaatttctgaagtactaatgtctatttcttgttcaatacagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagaggtaagacaaaagatggcacatgggtaagtgttaggaaatacaggggaagaaattgaagatacatattctttctattctttcctttcttcagccctggatgtgactgaatctggtttctgttggcaatatagagtttcatttttaaatttatttttgaagacatcttgcacataatttttttattatactttaagttctagggtacatgtgcacaacgtgcaggtttgttacatatgtatacatgtgccatgttggtgcttgcacataatttttatcctaaatttaaaaaattgtatttagtgatttatcttactatagtaaatagtcgcaaaggatcctcacagctaaaagggatataaatgcctctgaagagaggtgaaaacaaacttggaggaaggtggcaaaataaatgtcaaagatcttcctttcccatataatctctcttttatggttttttccttaatgcaggatattcataactaagaaaagtaaatggttttctgttaaaggaataaaagaaaaaaatctcagagccctagtgtttactgaagcatacaaagtaaactccttgtgattattgatcttgtacaaccataaaaccaaagtaaacttatgctttcaactccaacaaaaccacaagaccagttaaattcaaactggggacattaacttaatgtgataggtaatagatggtacttatggctatggcacaggttcttttgaatttagcaagagaatttccccacttttctctttttgaagtaccgtgaaaacttctcagagagacttgccaaggtcatttgcctttaacttgttgctgtgtatcatttaaattagggaatcacaatttctggtttgtataagggccacgtggagagcttattaaaaaaatagttgtccaaccccagagattctcagtaggtggtcctctggtgagtcacttcttcaacccacaataggtattatttttttttctttcttactatttctgcttggactccagatttgaaatgtgattttttaagctgccccattctctcccaagttcatgatttcctcctcttagaaccaagcaaatctcttgagtagtcaggtggagattgactttcgttcttaagcctttccagctcctgactggttttctcacgaccacctgaacccaggagtcaggttgtcccaagtacaggttttgagaaattccttcttaatccatggatatttggtgattccaccgagttttcttgtcacaactcgaaaagttgatcactataaagcatttcatgttttttcataagatttctgccatttgggaacatatacacatattctttctatcgtatgtatcaattcatcaggcgggctttagaatttctgccatctgtaatttaccagtttgtcatcagttgcatattcaacatgttatccagattatgagagtcacctgtgatatgacaagtgcacacttccttttatattaatggttgcatctgaggcaaattatgccaattagtaatccaaaaccagttaaagtgtgtttatcaaatagcccaagggggctttttgttttatagcattaactgttcattatcagaagggaaacactgtcacagggaaaaatgtaactttgttccttttcagcactgaaattggaaacttagagtcataggtcaaaactatttaaaaaaatgcttttgaaattctcagaataatttattgtctgtgacgttactgtagataaggtggggtaactaagttgccatttcaaagataagaaatagaggtacagagaaaggggaggtaccagtgacaaaactgtcagaatgttgatttttaaaatgtaggccctgaagggttaaattgtcaagtctaggacttaaaagataaaactttctgcacctcctgatagccttgatgttaccagcaggttgttgaaaatgaaaagagatacatcattgctatcacttagtatcggtgaccactgtacaattaggggtttgtgggatgaagtctgggaatttgcctgacctgaaccacagcccccaggtagtaagcctcaatttgtacttttatcactcaaataagcctgtgtttatttattctttgaaaaacattgaaactatttgctgtgagtcaagagattgcccttggaatatctgatgtccaggatagaaagataccactgcaataagcaaaacaagttgatgctataagaaatgatggcttgggaggaagctctgaataaggaacttgtgggcattacaatactgtagatgaaggtggggtttcggtaaacctcaaagttgttagtgaaactggttcagctaaagattatgtgaaaagtagctctaaattggtctctattctccagtgatttgtctttgtatttctttgttgaacagtttttaagtgaaaaaatggtgtgtgtagagtgtaccaatgttttctcattttcccctagattaccaataaaagcaaagagtcaacatgggccttaattcacagtgtgagtgatgctttttccggctggttgttgatgctccttattgggcttttatcaggtatggtaaactgttagttttcaaaacaaatctcctaaaattgtggtatgtctctcccgtaagtcctgagctgagtcacgtactgtgttttcctgtttttctaccttaaatgaattgctggtgaaccttatagaagctcaatgtccccatctgtaaagggtactaatacctgcaattcttaccttgaataaatgaggaaatgcatttaaatgcattttgtacactataaaatactgtatccattttaaggtgatgttagccctttggtgcttgttttgaggaagagcccttctgttggagacagttttttttttaatacatactgcatgggttttaggagataagatgtggaagaggacttcctgagacattttgtgggtgtttcttaaacatctactctctcatttggtgatgcagaaaagcatgtaagatatggctcgtactcccaagaagcttatgatctcattctttcatagtggctgggggtggaatggtgccaccttgccctataaactccatcaaccttccctgccactccatataatatacagtctcactaaaaatggtatacttactgtacaaatacagctttcaaccaagttcccaagaaggtttctcacccggtggggagaggagagggccaaggacactaggtagagatggtaagaggtgtgtccttatggcattaaaggatagggcctaggcaaatctgtaatcttgagctgaaagagaagttaggtggaaacctggaggtggaaggtatacagtggtagttaacagcaagtagaggctctagttttaggctgcctggatttgaatccaagccccaccacttgctagttttgtggctttgagcaagtttcttaacccctggaagccttagtttactgatctgtaaaatggtgataatcaaagtccctatgttagaagtttgctgtgaggattaaatgagatatagcacataatagcacttattaagcacagcagacagttgttaatgctgctgctgctgccgttaccaagagagaataattcatgagccatggagtagaatgtgactgtagcaaatgaagaatggcttatctatagctgggttttaaaaaattgtctagggcagggattggcaaacttctgctgtaaaggagccagatagtaaatattttaggatttgtgggccaagtgttctctctagcacccactccattctgctgatgtggcacgaaagcagccatagacaataggtaaacaagcccagctgtgaccagaaaaactttatttgcaaaaataggagacagacaggatttggtccttgggctatagtttgccaacccatggcctagggtgttaactctgccccttctggctcttacaggagagagaacatggtctggctctttggagctgcctaataatagactgggtggtctgtaatgctaagtattgcagagaggctgaggacaaggaagatggctgagaaaagattatatgacctagcagttaggaacacagcaattaccttgaaaagccatctcagaaaaatattagaagctaaatctattcggtttgtgcaaaagtaattgcattacttttaatggcgaaaaccgcaattgcttttgcaccaacctaatagatttcaagggaaggcaaccactgtagaagttttggtagtcataggagagagaggaagggtaaaggcttgaaatgataacaaggacaagggacagcattttattcttcagggtaggggaaacctaatacaatttgtaaccagagaagaaagaactgactctggggaggaggagaggtagaaggagaagacaggattgagggtaccagtgttaggtgaaataagacatgtacacgtgagacaaccagagaataagccaaactgtataacatcatggtaattttccgaatccaggcagtaacagatagaaggcagagaagattgtggaccggagtggccaagagtaggtgtcaaacaatgtgttagatttgactagattcttcaagtatgtaagtaacctgtgttaacacttttagcacctaccaaaacatacacgacatggcttcccgcccgttggaatgtaggcataatatcctcaactttttaatgtatttcttgtcactaggtggtcagtgaatatttttctttcccttgtacacacagggtattttgtttttaagcattggagagcaacaatagaagcagtgtgtctgaatgctggaacagtctgggaattcaagggctgtgaattttgtgatggctttactatttccctaaagcatgattctgggccatttaatttctttatgccagagtttcttcatctggatgacagaaatgatgagaaggccagaatctaaattactataactgtcttaaccctatcagtctattagccacagtgcatcctaagtccccagttcacgattccatttcccatcattttctttggtgaatgttctgtgtataatactgtttgctctttctcagtaagaaaacttcaggatgttcatgtcctaggttcaggaggcctcaacatgtctatagcttcatctcaccttccatgcacatcacagtttgtgctttgatagattcagctcctttagcctagaatgccttcctgccattgctcaaattcccttgtccatggagcacaatcctgctattaaggcttagcccttctccccataatcttcgtcagctctcctctctaagcaatctcaaataaacatcatagaatattcctcaatgttgggcaattcacatattctgaatcttgtatatatgtatatatgtatatgtatatatatatatgtgagaataaaagaatctttaataaacttgactctttatggatcagtattcataaagttgaagtcaaaatagtgtttttgccctgttagttcagcttaaagacaggcccactagccccttgctcccacttaaccattttgctttccctaagtcccttctatgtagaaattccacagatggcagtgtttagtgcagagataataagtgaaaatcaagcaaacacacaatgagaaagaggttacaggtggaatggggaagtatgtgcttatctgttactttgattcctttcccctcattttctctgacaaagcttattctgatgaccaaagaacagtttccgagattcagtttaactttggcctttccctccctccccacaaatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgaggtaacatgtagtgatgttttatgagccattgacttttcttcttacatttattttatttcttatactgtgctcacagcaattgcggaatcttcctttattttcctttccacagaaaggggaaccagtaccagctgcctttctctgtggtttaagtgcagctctatttccatctctgctgatgtgtagagtcatttgacgcttatgtttaaaatggttttttgtttgctttactaagcctggtatttcttcttaggtactagtacatagtgtgactgaatttctctttttctaatcatttcaaaagaagtgtcagaggcagccaacaggtgagctataatttctaatgaaggacagagtgagttaaaaatgtgtttatgtatatggatttgaaaagtgattttccctgagcattgcattagaacattgaaaaaagtacaatgcattccatgtcaaaataacagaaacccaggaataaaattgcctatcatcccattttgtaatcaaatcaatattttcatttgtccttgtcttctagcatacgtttttgttttttttcttgagacagggtctttctctgtcacccaggctggagtacagtgacatgaccatagctcaccactgcagcctcaacctcctagcctcaagcagtcctcccaccagtcctcctcaggagtagctgggactaaaggcgtgcaccaccacacctagataatttatttatttatttattttgtgaaaatggagtcttactatgttgcctaggctggtctcgaactctttgcctcaagtgaccctcctgccttggccttccaaaatgctgagattacaggcatgagccactgtgcttggcctaccatatgttttttgatgccaaggtaactttgcttatttttcagttccttacctttattttaccactcagttatatgtttgatctctcccactgaaaacaaaagcacacaaagcaaaaaactctcaactcccaattccaccctgacttccaccaacaaagacaggtaccatcttagttcactactcatctattttgttagtgagggaaacaagactaggatgtatgtttgtacttttaaacatttatattaccctccttggtctacaaacaatttgaggtggcatgtgcacacacatacacaaatacaaacagtccagggaaaaggaggatagaaaaagaataaagatagaaataggagtgtttatatacatgtatgactatgcatcttggcttaggtaaagggttcaataaaagggatagatacatgccgtatgtttgagagagtttaggtctatgcttctcaaactagggtaaggtcagtgtgccagagggtaggtgaaactataggacaaacattatttgccttcccagagcattactttttcctgaatatttggaattttttttcaaaaattatatgtaaataatcatttaaaaatggaatgcaaaatttcatacttgttaagaaaaaaaaaaatctttcagctctgctcccgggtaccctgtcccatactctgatgcctttgtttactctctcctagattaggagaacttaggtagaaaagtttgagaagtcctacaacttagggtgggtgtgaaagagagagagagagagagagagagagagtgtgtgtgtgtgtgtgtgtgtgtgtgtgtgtgtgtatttcccttgcttttggggggattcttttattttaaatgtaattggccaggcgcggtggcctgtaatcccagcactttgggaggccaaggtgggtggatcacctgaggtcaagagtttgaaagcagcctggccaacatggtgaaaccctgtctctacaaaaaaaaaaaaaaaaaaaaaaaaaaaaaaaaaaaaacatgtatatacacacatatatatataaaattagccaggcatggtggtgagcacctgtaatgccagctactcaggaggctgaggcaggagaatcacttgtacctgggaggcggaggttgcagtgagccgtgatcgcaccactgcactccagcctgggcgacagagcaagactctatctcaaaaaaaaaaaaaaatcctctcctccaaggactgagtgaggtgtgcctcatgcctgtaatcccagcactttgggaggctgaggagggaggatccctcggggccaggagtttgaggccagcctgggcaatatatcaagacccctgtgtctaaaaataaaaaaactgggcgtggtagcaaccacctatagtcccagctactcagaaggtgaggtgggaggattccctgaacccaggagatccaggctgtagtgagcaatgatagtgccactgcactccaacctgggcaatggagtgagatcctgtcacacacacacacacacaaaagtaattacagattcataggaagttgcaaaacaatgtacaaggaggtcctcagtacccttcccccagccttccctccctcaatggcaacagcttgcataaatgtagtaccatagcaaaaccaggaaattgacataggtacaatccacagactttagttcaccatttagtttacacacattgatttatgtatgtatttgtgtgtgtgtatgtgcgcgcacgcatgtagttcatagttcattgccattttgtcctatgtggacatttgtttaaccaccaccacagtcaagatttagaactgttctatcactgcagggctgcctcatgctgcccctttatagctgtatgtgtgtaagcattccaacagttactttcaaactggagcttgagatttgctctagtgacagatttctctggctcttctttttatgaacgaaatccttccctggggaaagagtcctctaggttttggtttttgtttgtttgttttttgagacggagtctcactctgtcacccaggctggagtgcagtggtgcgatctcggctcactgcaagctccgcctcccgggttcacgccattctcctgcctcagcctcccaagtagctgggactacaggcacccgctaccacgcccggctaatttttttgtatttttagtagagacggggtttcaccatgttagccaggatggtcttgatctcctgacctcgtgatccgcccgcctcggcctcctctaggttttaagaagccttctccaaatgccaggaaattgccctcctggtctctgcctctggccagtttgagttacttttcctttcactcccttaccctcttcatttcctacctctgcagtcttcttcctccttagctacattggaaaggcaaagaaatagcaatcatgtgttcctctgagggcctaagataatggaaaacctgtgtcaaatttacaactcagaaaaaacctgagcattctggttctctttgtctaggtcagtgagttactttaatagtgttttgtgttatgaagtcaaaagtccattgggttttgtatttactgagtgagttgcaattcctaatatttctaccagcaagcataacttcctaatcaaaattgctttttttgtaagacatgactatttgcaggccctttaatatggatgaatctttcctgctggtcaaagctagatttcttttgtggcatgcttcatttatcacaggggaatagtctcaaaaagtatattctttctattttaaaaaatagttgtttccattttatttatttatatctggtaccaccagggtccaaaactttctacttatatggttgttcctgagtctgtggtaccaaaattttcttgaagatgtagttatatgtggactctaaaaaagaaagttgagtaaacagaaccagagagcagaatggtggttacctggggcatggaggaggaggaaatggggagaagtggaccaaagggtacaaatttgcagtgaggtagggtgaataagtctagagaggtaatgtacagtagagttaataatgctgtatactaaaaatttgctaagagtatattttagatgctcttaccacacatacaaagaaaggtaactatggaaggtgatatgcatgtaagtttatttcaatgtagtaacaatttcgctatatgtatatatataaaacatcatgttgtacaccttaaatacatacaataaaaaaattttaaaaagcaaagaaaaaagccaaacacccaaaattttgttactataaactatgagaatttgacaccaaggtaagtagccaaaggtgaatttagtggaactttagatccgctcttcacttcagatgtgaagccaaggttcagccattccaaaaaagctgggggggtgctcttaagactcttggtaaaatgacatggaatcatatatatttgactacaaaacccatcaaagcactcatatagaaagagaattttgtttcatggttttccgtttgctcttttccttgttcatccttagaatccatggtaaatttcctttgggtgtagcaaagcatctcattttcagtactaagtggcctgacagtgtttcagtagttgacaattcagaaagaaaagtcttgaacaatttaatctcggtggttttttttttttttggactttttttcctgaaaaaacattactcagaagagctgcatgtctcactgaagctgtctaggctaaaacaagcttctttttccccctgttccagggagcctttgcctacatagtcaattatttcatgtacgtcctctgggctctcctatttgccttccttgccgtatctcttgtcaaggtgtttgcgccttatgcctgtggctctggaatccctgaggtgagtctcttaaaatggtttataaatggttacaatatgaatactttttggttaaaatctcttaatatgtattccagcacataccacaatttgatgaatgttaaacaggatcagatcctgaggccatctaagacctaggtctttccacaagtccctctcagcctgggctaccaggaaattaaagggagttgattcttagcctcctgagggttcctgttgagccaggctctggaaaacttcccctgttccctatccaaaaagcttccagagtatatcccaagattctgacctgaaaaagcagtgttattgtcagctttttcagggcaaaagaaagaaaatcatttggtacctttcccacaatatgatttaggctacatgggatggttaaaaccctgtttctaactacttttggcttagattgcttgacagtgactaaagacactgagacttaggttaccaggatgactttgcccttccctgtttcctgaccaggtaataagtcacaattttttttttttttaagccagggaatcaagactatacctaacctttaaggttgtttcagggacattagccttgtcctctcaaaacatgcctcttgggctaccacgttgtaacatgaggaaaacacctatccctccctctccagctcctccttcatatatgcacactctcatacttacaatacatccttgcccagctatcactcccctccccctaaaaagggggaacatgaaagcttaaagaacagttcttgctttcttgggctcctgggctctcttccaaacagggatcactgtaggtcaagcatttatatgtcacttattcaaaaggtgcagtttctataatgaggtccagatttttgcttcttagccttgttgacttccttagtctatattcaatctttctgtgtttaacctgcagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtaataatgaatggccttaatagtctctttttggttgtgagcataaatgatacaatcttagggggtgagaatttgagagttctaccaatgttaatgcaaacaccctttgacccagcaattccacttgtaggaatttatcctacagatatcctagcatgtgtgtgcacaaaggtgtataaggatagtgcagcgtctgtcaacatagtaaaaaactgaagcaacaaaaatgtccatcaatagggaactgatctaataaatactattctgttcatactgtagaatactttgcaaccattaaatgagataaccttttatatattgacttggaattctggctatgaaacaccatttgattttaaaagccagtttctgagtaatgtatataatataattcatattttttaaaagtgtacatgcacttattgatagaaaatgtctggaaggtggttttaccccaaactggttttacttttttttttttttgagacagggtctcactctgtcacctagactgcagtgcagtggcatgatcacggctcactgcagcctcgacctccctggctcagatgatcctcccacctcagcctcccaagtagctgaaactacaggcacgcaccaccaaacccagctaatttttgtattttttgtagagacggggtttcactatgttgcccaggctagtctcgaactcctgcgctcaagcaatcctcctccctcagtctcccaaagtgctgggattacaggcatgagacacgatgcctggctcacgtcaaactgttaaaaatgtttatctatggtgagtgggagagtgaggggtagtgaaggagaagtaaggattttaactttttattgtatgtaattctattcaagtatatattgcttctcttacaaaataagttacagaaagaatagattttaaaagaagttgtttattgctatggaatagtacatataagtgcagtgtatgtttcagatgtcggttttttcactttctatttctatctaacactatacttgaattagtttctctctgtattggacctctctctaccttttgtttcagcccagctaaattagtcccgccatggcacctctgtagtggctgtcatgtttatgcagttgttaatgtatgctgttttgaggaggaaggacttttttaaaaaaaagttccaagtcattggtttacttttttcttgctataattaagggcctaagagaataatggctcttgctttattttctttgaattacaaagaagtcacatatggaatgggtcaagactaaggtcatttcacttaaaaggatttttcacaaaacaggaacctaatgatttcttatgaaaaccaaaaaaaaaaaaaaaattaaccacaagacccagaaggaaactcaaagatattgagatttcaaatatagaataaattttgttggttcaagggagaaaggtcctggcactgttagaaaggagaggaaagctagcaggagagaagatggggaaatatgagtagattgtttaactacctgtcatgcagtagagggacttaaaggtagtgttaagttggtgaggttgttaaatgggaatgacattcaacagaagggaagagttgagaaaacattttttttctagaagggctttattagaacagttatgaaatttgaatgagatttatagatcaaataacagttattagtgtaaatttcctattttgatcattgaactgtgattatggaagagactgtctttgcttttaggacataaaagcatttatatcctacatgcactgaagcatttcagggtacatgagccttatatgtgcaactgacttttctgagtgaaattccaattcttcagaaaaaaatagaatcataaaacaaatgcagtaatggtagcaattacagaagctacatgaagatatgtaggacttctttgtgctattctttcaccttttctgtgtttgaaatttttttaaaaaaatattataatggttaagagtgaagtggtgattgttgctggttttgcatggatgaaggtgaatttgaaactacagattgctggggactttcattctaaaaattggcatttttgttcaaatagtttctaataaaataagaggggaattcgatttggctgtttctctctacagatgccatatatttctccagttagactcatatgaatacagtcatgtctcaatgacagggatatgttatgaaaaatgcattgttaggagatttcgtcactgtgcaagcattatagattgaagttacacaaacttagatggtctagcctactacacacctaggctttatgatatagcctatggctcctaggctacaaacatgtacagcatgcgactatactgaatactgtgagcaattgtaacacaatggtaaatatttgtgcatctaaacatagaaaaagcacagtaaaaatataatataattttatggggccaccatgttgtatgtggtccatcattgactgaaacgttgttacgtggtgcgtgacagtatttgaattggttttttttgtttttgtttttgttttttttttggagacagggtctcagtcttttggccaggctagaatgcagtagtgtgatctcagttcactgcaacctccatcacctgggcttgagcaattctcccacctcagactccccagtagctaagactacaggcacatgccattatacccagctgattttgtgaatttttttgtagagactgggttttgccatgttgcccaggccagtgttgaattcctgggctcaagtgatcctcctgcctcagcctcccaaagtgctgggattacaggcatgagccaccacaaccggctagtatttgaatcttaaatttactttctagcacttatttagactttccagttattttttcctgttgctttcatcatcagcggcaaccttttttgtcttatggccttgtcaaagtgggcagatggttgagagtaaaacagacttgagaaagaagggtgtagacagactccactctacaatataaaattaaagcaaactagctaccccgattctttctgtctcttgattcatcctaaacatagtcactgaaatcccctttctcaagttgcatgttggctgtcctcatctttcttaaatgaaagccattgtagctaggaatttcaaagcccttccagctagcaccagagattccattctttcctccccatcattttcctgagccatcctactcttccagataatcctatatgcttattttgccaaggacctttttattcttcaaaactcgtaattttgttcaactttctctaaaatatttctttacttcttcaaatcatctctctccatagcaaccagaatccaatgaaaggacttggtccatctattaattttggtttgtttgccattattagtgtttgtcatgtacattttacatgtacacacacacctacacagaggtggaggtctctaagtatcactattctttctctctttatcactttttccctttggctccttcttcctctcccactctctcctagtccctttccttgccatatcttaagtcttcccttaaaaatctagtcacctccctatttctgtgtccataggttattgggcatggagtaggacacagggtacgagagactctaaatacctattgcatgaatacttgcagctgctgaataactgtgaaccaattgtgacttcagttttatgtcattagagccttcttgaacatctcatttaaaaagcattcctttgcaaagttccatataaataaatacatcactgtaagtacatcatttagatggtgaacaaataggcctagaaattcaaatgcagttactgaattgggagtatgggagataagggcgggggggcggtgcataatttagaataaaacacatggctaaatgaattacaaaggaaaggtcctcttacctggtcaagcatgtgaactatgcatgtgtattcaaaattcagcatacagtgtttgaattttgtttttgatgatatggaacatctagaggtatttttaaatgttcagtaactactaacatttcttctaaaaatgtgattgagtgattgaggaaagcagcattattctgtcactaattctgagttttggattttaggtcttgtcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaaggtgaggaattcttttgggactcagtggctgcatgcgtagctgtgggttttggagggcagagcccaggtatcatacaatcctgatagctcatatggtgctttcaaatccccctcacattattcccccacccccaaagcctcttttaccccacacgttctcataatttgctagacacttgtacctctatctcaaattgtccaagccttgagttgtccaaatgccagcctcagtgatgaaattttaggaagaatgtttgctccttttctgtggaaaacatattttgcccctcaaaaatgatggtgaagtatttattccagtacatttcatattaaaatgatatctgaccaccacagtgttactccttatagggtggctttagagtttaccaataaagcacaatattgattgaaccaaagaagttgctgggattcgaccattttgactgctaaaatggcaatttcctgtggttcaacccaatatatagctaaatatagttttttacagtggtatcaatgttcagttgtcaagaagtgggatccacttcacaggtgatccttagttaatatttaagctatcaaaagtggacatcaggctggcacgttttactttaggtacctgttaccatttccacgtttcagaagaagccagaaaagaaaatttgttaaggtattttcctcctcctttctaggtttttgtttgtttctttcttttctttagcaccctaactaccaagttattttcctctattctctagagaaatggagattcaagccagaagagatagcaactcagtttaggcattattgtaatctctaagatgacgccatccatcccctcaatacagggaagggatggagaccctgagaaattttgcagtgcttcttgagttaattttcacctcatgcctgcattctttcacttaaagggaatttgtaaaccatcagaacaccagattcaaatgcattccaaaatcaaacacaggctattttaaaagaatctgctgttttggttatccttatcatcatttccctctctcagtacagaatattaagaatttactatagtatcctaggagtcaagaaaaagagtggggagatagatgagctttacttttttggttaatcttgtaaccatagtcatgatctcattacaattttttaattgtttaatctttcttgatactgttacaaaatagactgaaacctcatgtgctatatcctttttgtgtgagcaatgggctaagattcaatatatgagcatggttatgagcattccatttaaatcccagcaccagtctttactaaatcttgaccttgggtgggttacttaacctctctgaaccttaggttctttggcatttgggaataataatgcctgcctcctggggttataaagaacccatgaatcttgcatgtagagcgtccagcatagaacatggtaggtactcaataaagggtagtcattgttgataagaattcaaaattggtggaaatgtctgcatatatgagaaactccatctattttcctttttctttgggaaaggcccaatttctgcctccagttctgtgttggtctggagagttcaggctcttgcctgatggaccccgaatcagggtaagcttctttgcagtcgtccttgcctgcacgtcccagagaacctctagtccctgtagtgttacacacacctttacagccacttgctagcatagtgcatagttaaattgtcatcggcctgtttgctttgcagagggtcagtcctccagcccttaccatgtgccaagcaatcacatcatttctcactaaccatctattggtttctctttgcagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtgagtagtgtttgcattaatttcaagttgctacccaggtgacatacaacagaagagtttattaaacacagttgactgtaggagaatttaaatgcccatccctttccagttaggtttgccattttccaagcacattaagaaagcatctggtatacagatgaggaaactaaaaaaaataaaaataaaaatcataataaaaaagaaaaggaattctactctcatactggggaaataatcagaaatttagacaaagatatctgcacaagaatatgtatcatagtataagagcaaaaaattagaatcaacctaaatttgcacttgagggactggttaaatgaattatggtacatccatatgatgttatacaatgcagcctttaaatgtgatgttaattgttaatatgtttaacatcttaaaatatgatgttatataaatttgtaataatatgcagaatgttcccaacataaagtagagggggaaacatggcagaaaattaaacatataatgtgagttcactcatttaaaaacatatgtttttgcatagaaaaaaacttgaaaaagtcattcagaatttttactctgcttatttattggcagtcagctaatagataatgactttcttttatattttctggattttccacaatggcatgtattttctaattagggaaaagaagcaacagaaaaatgaaagaacaaagaaacaagaaggcatcttggactggacatggtagctcacacctgtaatcctagctacttaggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggtaagaagtcttgagtgaagtcaaattgaattgtgggagaaagagaatgcagagatagaaagaagtagaaagaagtagaacccagtttaaatgaacattagtagcacttttaggacttcttgaagctctgagatgaaagtggataggtttttttaaatcataattaatgtaaagggagtttgggaaagaacatgtgtttgagagatgtgaactgctggttgcatattataaataacccagttcctccctgacaaaggaaacacctgtgttttgtgcataggcagcactgaaattacagtagcatcaggtaatagtgtatttgctgggtgtttgttccctacaatctccttattattacttgaggatgagaaaaccaagtttcagtgaggtgagatttatacaaagttctccagctaataaatagtagagaaaggctttaaacacaagtcttctgactcccaagcccatggctctttccttcctgggatagttcttatccagtaaagggaacccttctatttttattggaaaagaaaggaggttgaggagaggggtggatttttttcccaaacatgctacgttaatccagcaattatataagaatttcacatctgaaatttctaaatggtgtaacagatgccttgcaggatttaaatcagtaaggggagttccctaactggttcattcaacatctgctgaatccctgctccatgtaagaaggtactccactggattccagggagacacaaaaattaataagacccttctgtgccctcaaggagcagacagtgttttaaggaaggcaagaacctagcagtggttatagtacaatagcaaagaggacaagtgccactgaggaggcctgcaaagaatgtgcatgctgttgctgtgaggagggcagagttcctgctggctcatagaatcagggaaggtgctctggaataggggcgtttgaactgggctgcagtagataagattcagatatgtagcgaagagtatttaaaccagaggaaatcgcagggtctgagacctagaggtagaaacacttgcatacatttaggaatccacacatcatcctatttgcctggggcacatgtcctactcctgtgatctcatactgaaagggcagctagtgatcaaagacaaagttgaaaaggactgaggaggacaagtatcacctttgggaatgctattttaactacagatttatttttgtttttttgtattgtgtttgtcttttaggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctg

SEQ ID NO: 2254 - DNA, 176669 bp, Homo sapiens; identical to SEQ ID NO: 2253

SEQ ID NO: 2255 - DNA, 67373 bp, Homo sapiens
caggtgtctggaactggattacagtttcttctgattgaacgcagcctttgaatactgcctggcctatcgcgaatacatgtgtgtgcagttattgttttctctgtagggtcataattgctttgccaggaccccatgccttttaagaacattggctctaccagcttgcctccatactatatgagctgtcatgttcttccttgttttcaatgcaaaactcctatgtaatttgtccccagtgttgctaggcctaaactaggggctagacaacatcccagcgttcacagaggatggtaggcactgtgcttggctttttacataaagtgtctcatttaatttgaacaacaccctgcagaggtaggtatacttatctccattttacagatgaggtaactgaagcccagagattttaagtcagtcacttgcctgaggttaattgtgataaaaccaagatttgaatccagatcttcccaacatcaaaatctgttttctcctagggatgctatagatagactgggttttctcaagaattttcagagaatttatcgtgtttctggtgaatggtgttaaagagcctctttctgattacagccctgccttggacaagacgcagctgaatctctaagtgatgctactgccactaccaccccagagctccaaacctgtgcctaagaaatctcagtccagcaaaattgtgcccagtcatcatgacccatctgaaaaggttagagcaagctgtctttcccaacaatatctttggtagtctcttcctgtgttggctcagtacctatcctcacctgtgagtcttttgaaatatgtctggtttaacctgagaaagtggggaggggtggcagcccttgtattggagaatgccagcaaattagaacttggggagaaagtatggactcttcattcccataaatgcagggctcaaatgaaggccaccctccataaccctcaaaactgaacaacactcagtcctcattaatgatcatgtctatattcttactttctctgagaagctccaagcaccttgctgaaagactggtacattctggggagagtatgaagattatatcagcacatatattattatgctttttatagctattaaatttgaagaatgggtatattttgactctgctgttttgactttattgatagtttgatgttctaaccttaggatattctgtgttcatcatcatacatattttaatcagaattatactagcactgatgaattggcatcaagagagtatttcctggagcaaaacatcattaggtgaatttaatttccttgattggttttctctgagcacagataaacattttctaatcttgcttattttactaaaatgattttcagcgaggtgccaaattttttcctatgtaaatttttcgagaaagatttgatatattgatcagatttttgtcaacatcaaattttcggattagtgttctgccattgtaacttttctttagtggcaattatttttccaaaaccaactttcttggagtacattttgcaaatctaagttttattgagttcagtttcagctataattttatttggggtcaattatttctatcagtaatattaaataggaattggataacagtttatttcttagctaatttctgagaaaataatgtttcatttttggctaatttctagtgggattatttatcatcagctagatgaaagactaatagcttacttatgtcttggcttaatcaattagaaaatggaagtaattcttctcagcttgttctgttttgttttgagatggagtcttgctcagtcacccaggctggagtgcagtggcacgatctcggctcactgcaacctccaccttccgggtttaagcaattccctgccttagcatcctgagtagctaggattacaggcgcctgccaccatgcccggctaatttttgtatttttagtagagacggggtttcaccatcttggccaggctggtcttgaactcctgacctcgtgatccacccgcctcggcctcccaaagtgctgggattgggattacaggcctgagccacagtgcctggccctcagttcggttttttttttttttttttggttgttgttgttgttgtttgtttgtttgttttttttgagacgtagtcttgctctgtcaccaggctggagtgcagtgacacgatctcggctcactgcaacctctgcctcccaggttcaagcaattctcctgcctcagccttctgagtagctgggactacaggcatgcgccaccgcgcccagctaatttttgtatttttgatagagacggggtttccccgtgttggcccgaacggtctcaatcacttgacctcatgatccatccgcctcagcctcccaaagtgctgggattacaggcgtgagccgccgcgtcgggctccagctcttttaagattgctctctctgctggattggtttattgtgtcatgaatccaattctggtaacttactgtgccatgtattaagtgttaatggtacagctggagaacagagcaaatggtctgatcccagtgtcctgcttcacattataacagctctctgacacaggtagggcgggtttgttttcagaatttcataagggcagtctgagacttaggagatttttaccacataaagttgttagagggtagaagactcctatagtgtggtttgccctaacctctaaccctatagagatggtcttactcatttgggaatggggtaaggcaagcacagacacagaatatgtgggaaaaaagccccttctgctttaaaatattcatcccccttcccttccccggcccctcctttatatatactaacaatcagagattaatctggattactaaactttgtttttaatataaaattttccttgtgaggtttacaatcatatcagactacattattttaaatactatttctgcccatttacagttcatacgaacttttaaaaaacatgtattgtcttatttaatcttcaaggactgtaaggcaagttatccagctttactgataagaaaattgaggattagagattaagttacttgtccaaggtcaacagttagtaaagagctgatcctggagcagtatctagatgtgtgtgctattatccttactggtaatgtcttttaaaacaggtccccaacccctgggccatggagcagtatctagatgtgtgtgctattatccttactggtaatgtcttttaaaacgggtccccaacccctgggccatggaccagtactagtctgtggcctgttaggaacccaactgtacagcaggaggtgagcagtgagtgagaaaagcttcatcggtatttatagccactccccatcgctcatattacttcctgagctccacctcctgtcagatcagcagtggcattagattctcatagaagcatgaaccctattgtgaactgctcatgcgagggatcaaggttgcgcgctccttatgagaatctaatgccttatgatctgtcactgtctcccatttcccccagatgggactatctagttgcaggaaaacaagctcagggctcccactgattctacattatggcgagttatataattatttcattatatattacaatgtaataataaatgtgcacaataaatgtaatgtgcttgaatcatcccaaaaccagcccaccccagtgtccgtggaaaatttgtcttccatgaaaccagtccctggtgccaaaaaggttagggaccgctgttttaaaagctgcttaacataagagacccttagatatttgttaaattattaaactgatctacctgaaaaagctgcttaacataagagacacttagatacttgttaaattattaaactgatctacctgaaacatctatattaaaggaatgactaggaatggtaggggtggtagtggtctaccttggataggataaccgtaagtatgagagaagtaagaggagaaatgagctttactgagctacactttgctcattttgtgagttacactgaaggtcatcttgcctccttgtagacgtaccccattaacaatgtctaccacctttagggacttaataaacagctctgagtgccataatttccttttgttatagtttattggggtttattatatgcatcctcagttactctgaggttctggagttcccctgagccctaaagaggacccaaagtccctgaagagactgttcacaattggatatactcatttacctcttttacttttttagacgggggagaattgccaaacgaagatatctccatcttcacttcaggagtctccatcttcacttcagggagcactcaaaaagagatcagcttttgaagatctcactaatgtgagtatgctagtccaatcctttgctatggttttgcataaggcttagacatgctgtttcttgagggacctttccactttaccagaccctctctggaatcttgacagcaaattttatttgggaccaatgacccagtttcagaaactgcaggggctctgttcctggcacataccatctgaaacaattggtggagttctctggaagcagcagacagtgattatcagatatgaaattgcagataactatgagaactatggaattttgcatttagataaagtccagaggtgactgcccaggccttcgaggtaagtattttagtggaatcattgtagtccagtgcagtgtttatcaattcacacattatggacattttgagcaggacaatttttctgttgtgtaggactgatctcaactagcacccctcgtcctcaggcattaaattccaccagcagcccagtcatagtgataatcaaaaatgcctccagatacacagaactgttgagaaccatagttccaagatcgagtctttatgaagatctagaaattcaattttggctagaattctctcaagtaacctcccttctggtattattaaggtaccagtaaaaatcagaattaatagaatgttgttaattgaatatagaatcaggccaaaggcaatctttgtcttagaaaataataataactggtacacttactgggtgcttaccatgtgtcaggcactatgctaagcatgttatcctgcatcagctcacttaatcctcatgtaatcctatgaggtagatactataatatcttctttatagatgaggacttcaccaatgttggttttgaagtctgtattatctaggctatagataatcctggtgaactattcttgccctgcattatgtagtatacttatgtagctaccagaatacttgtatctactaaatagtgttttactcccttgggcataattggataagcattggtaaggttctttcctttagatcgctgctctttagattctgtatggccacctttctgcaaatacaatctcttccctatacagattacaacatggttttttaagttacagctttctgcataatttcagatttactatcaattggtagaaagagccccttcccacacacacacttgtaaggttagattaatttcctgacttatttaaccatggatacagaatttggctgaaataaggtagccacaaatcaggagcagatgcagcctatcttagtgtaacttgccttggcccctccaagtccctgatgggagtacagtgacactgtgcaaggaaagtgtctaagtccatgtgggcaattatcacaaaacaccttagactgggcaacttaaaaacaacagaaagttattgctcacagttctggaggctgaaaagtccaagatcaaggtgctggcagatttggtatctggtgagggcccgttcctcatggatgacatcttttgcctgtgccctcatgtggtggaagaggcaaacaagcttcctcgggcctcttttataagggcactaatcccattcacaagggctgtgctctcatgacttaatcacttctcaaaaggcctatctcttaatagcatcacattggagattaggtttcaacataatgaatttcaaagggacacaaatattcagatcacagcagtaaagtatcacagcgcatgagaaactttcttgtgacatctcagtcccttttttcatgagtttatcttaccattcagaaagaacagatatacatgaagtgtatcaataatgggaaatccatgcaggtatctaggaccctcctgattctccagctgaattgagcatctgtttggccatatccccatggggttagggggcaggggagcaagggatctctgagcagagtctctgcttctagctctctggctgctcagaaagcccatttaccgtttgcgctcaagttctgaagatttaccttggttaccttgaatggtctttggtgccttccagagacagttccatcattacaatgtacctaagccattcctagggttgggcattactgcagatatctgagctcatctatttgacagttgagggctcctttctctctgggttttggaggttccctatatgataatttgcttcttacagtcagtattattaggtctccatgtcttcatccctgtgttcttctcaacatttgccacagtgagatcctggcctgccaaaaagagttaatctgttttaattagttaatctgctgtgagtttttcttttcctctgccttatcatttctagcatgggaaggacttatgatatttaagaactggtgctaagccagtagacaaggagatagggcctatatccatgtttgcctaaatggttttgcgtaagtaggactttcatttatttttatttatatatgttattttatttattttttttgagataaagtcttgctcttctgcccaagctggcatgatcacagctcactgcagcctcagcctcctgaatagctgggactacaggtgattgccaccatgcccagctaatttatgtattctttttgtagagatgggattttgccatgttgcccaggctggtcttgaactcctaggctcaagcaatcctcctgcctcgacctcccaaagtgctgcaattataggtgtgagccaccacaccaaaccttcacttctattttcctattttatggtgaaagaattatggggaagtacaagtaaaggtcccctggagcttaaacttgaaaatatcagtgctttgtacctgtatgtatggcaagtagagagtttcatcttgggagttatgatctccacgtctttcttgccatgaatgcacctcttttcccattctgaatcttgattgtacatataaggagtttgcaaaactttaggtgaagttaaaatggtgactgtgccaagctctttgaaaagcagaggtagatgacttgaggtcctaagaaagagtttcctattggactgtagttgtttattatgatctgatgatacaaagacatacttttttttctacatttaacttggaaataacttcaaatttatgaagtgttgcaaaaatgaaaattgtacaaagaacaccagtataccctatagtagattacttattgttgacattttgtcccacgtgctttctcatttgcttgtatatgtcatggtccctttacccgtaagtacagtgtgtatttcctaagaatagggaagttgtcttatataaccacaatatacttatcaattttctaaatttacattgatatagcagttttgtgtaatcaatcatctatattccaattttgtcagttgaccttataacaacctttatagcacgttttcccctccagtaaaggatccaggctaggatcatgtatttacttgtctttttagcctcttaacctggaacatttccatagcctttttttttaatgacgttgccatttttgaggatgcagtcccacccaactccccactttgtaaaatagaaaagtcctcattttgtttttgtctaatgtttgcttgtgactagattgatacattcttggctaggatactgtgtaggttatgttcttgctatccttctcaaagtatatctggaggcacaggatgtctgtctttcattgatgatgttaattttgatcacctgttcaagatgttgcctggtttttgtactgtatcattattgtttatctttttctcttgcaactagtaaggaatctgtaggacatactgtacaagcatgagccttcccttctccactgtttattatcagtatggactcctgagtccatattttccagaggtttactgttcattattgtactttattttggtgctcaaattgccccatctttggccagttaggagcaccttcaatctcactaacgtgtccttgtgacacactctcataattttttgagcattttctttccagcttaaaaagatgttccagactcatcttatgtctcctttgtccaagccctggagtcaaacatttctccagagttctggttccctttaatggggagtgatattagataccaagatattgatgctagatgtgctattaggatgtctgctttttctgcccattctgcagacagagctaggaaatatctgtatttttatatacacaaatgtgtacttatacatacgtctgtatatacaaatatatgtgtataactggttcagtcttgggagggtgtatgtgtccaggaatttatccatttcttctagattttctagtttatgtgcatagaggtgtttatagtattctctgatggttgtttgtatttctgtggggtcatggtgatatcccccttatttctgactgtgtctattttattcttctctcttttcttattagtctagctaacagtctgtctgttttattaatttttttcaaaaagccagctcctggatttgttgattttttttaaggtttttttgtgtctctctctccttcacttccactcaaattttgattacttcttgtcttttgctagctttggggtttgtttgctcttggttctctagttcttttagtcatgatgttaggttgtctatttgagatctttctagctttttgatgtgggcatttagtatatgtacacacatatacctatttaggaaatcatgaattcatgcagcttcaatttcaatacataaaattatttcttagattcactagtccttatttgtatgttctatattgagaaccctggctcccaagaacatcaacacatttacttaatactgtaatacagctaaaagagtttcaaaatggcttcatccaaaccactgtaataaacaaacctactaaaaagagttccagatttattagcaatatctacaacctcctgcagacctatcctaattgaggatgtatactttgaaggtggtagtcaaatactatttataagtgacttggattggttatttctggtcttttattctgctttattttttcctttaatgtagttatggtacttatttgaaatataattaggttcatttgtgtcatttaattttttaatttttaaaacttttttgagacagggtcttgctctgttgcccagtctggagtacagtagcgtggttgaagctcactgtagtctcaacctcccggactcaagcaatcctcttacctcattccccccaagtagctgggaccataggcatgtgccaccacaccgagctattttttttattatttttttgtagtgacagggtctccctatgttgcccaggctggtcttgaactcctgggctcaagtgatcctcccaccatggcctctcaaagtgctgggactgcaggcaagagccactgtgactagcctgtttgtttcattttaaagatataactttaagtgtatttttactgacattattaacagtcccatgatctttcctactgtttaatagtgttagtcaggattagagtctgtgtggaactccccaaagccctgagttaaataaatgccacttagtgagatgggatagatatatcacaggtagtatgtagtgttagaggtatatcctgaagaggcacacccagacagcaaagtcaatcatactgccttttttcccctctgaaaatcttatgaggtcaaagtggagtatgatgttaacacggcatattttcagttatgggccagctagtaggcctggcatagagcacagaactacatcctgtatctcttggaaacacatagggctgctagttagccaacacataccagtactactgcactggttgtttgatgctagcttccactgtgattggttggcccactgccatactggttgtgagatgtttggattatcactcctgggaacacccaaccaacttatgtgggtcaggactttcctatgagagccaccttttaggtaatttgtggttttcttcattttcttgcctccttcttcccctgccccccaacccacctttttttttgcaggcttctcaatgtcaacctgtccagcccaagaaagaagccaataaagagtttgtaaaagttgtttccaagaagataaacaggaacacacatgctcttggactggccaaaaagaataagcggaatctaaaatggtgagtgaaaggggactcagatggcattattttagatggtagagtatgtgacatccttttgtccccattgagaacatatttagcaagccacaatggtgactaccacattaaccctgggtgctgaggtgggctcagctgtggttgctgaagagttaaaaaaagcctcttctgtctctcctctttcattacgtgtgtgcatattgaaagagctcttgtcattggaaaatttgccaaaagaccttgtgctcatcttttcctgtcttttagtaattcagtacctgtttgagctagtctgtgctttatagtgtggagacaacttaactttccagggattctcagcagctgactggtagcttgccagtcagcttattccattagaagctttacgggaggtttgtcccatgttactggagataaattactatctccctagagcaaaaacatgtggttttcagctgttacaggtaccgttcacaggttctacaagtacagatgcacattcccatttaggattggaaaaataatttacctctaggaagactttatcccctcctcattccggtgggaattattcttcagggactaactaatctacatctgaatagattagatagctggctattacagggctaaagtcaatcatgttgccttattcccctctgaaaatcttatgaggtcaaggtggagtgatgttaacacagcatcttttcagttatttgctagccagaaggcctggtatagagcacagaactacatcctgtatctcttggaaacatgtagggctgctatttagccaacacataccagtactattgtactggttgtttgatgctagcttccactgtgattggttggtgcggtgccatactggttgtgagatgtttggattatcactcctgggaacaccaaagggtaagctaaaaagactgggtaactctagaaaataacacgcacagtccacaggatattgtgctaattacccagcagaaagaagattagcatttagccttacttggtttcctgctgaaatggaattctggagtttgcatgcatattttgacctcaattctctgcgttattttcttttgaatttctttcatcattctgactttatttttttatgtttctttgtttttttattattattattattatactttaagttttaggatacatgtgcacaacgtgcaggtttgttacatatgtacacatgtgccatgttggtgtgctgcacccattaactcatttagcattaggtatatctcctaatgctatccctcccctctcccccgaccccacaacagtccccagtgtgtgatgttccccttcctgtgtccatgtgttctcattgttcaattcccacctatgagtgagaacatgcggtgtttggttttttgtccttgcgatagtttgctgagaatgaaggtttccagcttcatccatgtccctacaaaggacatgaactcatcattttttatggctgcatagtattccatggtgtatatgtgccacattttcttaatccagtctatcattgttggacatttggcttggttccaagtctttgctattgtgaatagtgctgcaataaacatacatgtgcatgtgtctttatagcagcatgatttctaatcctttgggtatatacccagtaatgggatggctgggtcaaatggtatttctagttctagatccctgaggaatcgccacactgacttccacaatggttgaacgagtttccagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttcagaaatgtctgttcatatccttcacccactttttgatggggttgtttgcttttttcttgtaaatttgtttgagttcattgtagattctggatattagccctttgtcagatgagtaggttgcaaaaattttctcccattctgtaggtttcctgttcactctgatggtggtttcttttgctgtgcagaagctctttagtttaattagatcccatttgtcaattttggcttctgttgccattgcttttggtgttttagacatgaaatccttgcccatgcctatgtcctgaatggtattgcctaggttttcttctagggtttttatggttttaggtctaacatttaagtctttaatccatcttgaattaatttttgtataaggtgaaaggaagggatccagtttcagctttctacatatggctagccagttttcccagcaccatttattaaatagggaatcctttccccattgcttgtttttgtcaggtttgtcaaagatcagatagttgttgatgtgtggtattatttctgagggctctgttctgttccattggtctatatctctgttttggtaccagtaccatgctgttttggttactatagccttgtagtatagtttgaagtcaggtagcgtgatgcctccagctttgttcttttggcttaggattgacttgtcaatgcgggctcttttttggttccatatgaactttaaagtagtttttttccaattctgtgaagaaagtcattggtagcttgatggggatggcattgaatctctaaattaccttggacagtatggccattttcacaatattgattcttcctacccatgagcatggaatgttcttccatttgtttgtatcctcttttatttcattgagcagtggtttgtagttcttcttgaaaaggtccttcacatcccttgtaagttggattcctaggtattttattctctttgaagcaattgtgaatgggagttcactcatgatttggctctctgtttgtctgttattggtgtataagaatacttgtgatttttgcacatggattttgtatcctgagaatttgctgaagttgcttattagcttaaggagattttgggctgagacaatggggttttctagatatacaatcatgtcatctgcaaacagggacaatttgacttcctcttttcctaattgaatgccctttatttccttctgctgcctgattgccctggccagaacttccaacactatgttgaataggagtggtgagagagggcatccctgtcttgtgccagttttcaaagggaatgcttccagtttttgtccattcagtatgatattggctgtgggtttgtcacagatatctcttattattttgagatacgtcccatcaatacctaatttattgagagtttttagcatgaagggttgttgaattttgtcaaaggccttttctgcatctattgagataatcatgtggtttttgtctttggttctgtttaaatgctggattacgtttattgattttcatatgttgaaccagccttgcatcccagggatgaagcccacttgatcatggtggataagctttttgctgtgctgctggattccttttgccagtattttattgaggatttttgcatcgatgttcatcaaagatattggtctaaaattctctttttttgttgtgtctctgccaggctttggtatcagaatgatgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttcagagtctgttatttgtctattcagagattcaacttcttcctgatttagtcttgggagagtgtatgtgtcgaaaaatttatccatttcttctagaatttctagtttatttgtgtagaggtgtttatagtattctctgatggtagtttgtatttctgtgggatcggtggtgatatcccctttgtcattttttattgcgtctatttgattcttctctgttttcttctttattattcttgctagcggtctatcaattttgttgatcttttcaaaaaaccagctcctggattcattgattttttgaagggatttttgtgtctctattgccttcatttctgctctgatcttggttgtttcttgccttctgctagcttttgaatgtgtttgctcttacttctctagttcttttaattgtgatgttagggtgtccattttagatctttcctgctttctcttgcgggcatttagtgctataaatttccctctacacactgctttgaatgtgtcccatagattctggtatgttgtgtctttgttctcgttggtttcaaagaacatctttatttctgccttaattttgctatttacccagtagtcattcaggagcaggttgttcagtttccatgtagttgaacggttttgagtgagtttcttaatcctgagttctagtttgattgcactgtggtctgagagacagtttgttatagtttctgttctttaccatttgctgaggagtgctttacttccaactatgtggtcaattttggaataggtgtggtgtggtgctgaaaagaatatatattctgttgattttgggtggagagttctgtagatgtctactagatccacttggtgcagagctgagttcaattcctggatatccttgttaactttctgtctcattgatctgtctaatgttgacagtggggtgttaaagtctcccattattattgtgtgggagtctaagtctctttgtaggtcactaaggacttgctttatgaatctgagtcctcctgtattgggtgcatatatatttaggatagttagttcttcttgttgaattgatccctttaccattatgtaatggccttctttgtctcttttgatctttgttggtttaaagtctgttttatgagagactaggattgcaacccctgcctttttttgttttccatttgcttggtagatcttcctccatccctttattttgagcctgtgtgtatctctgcccatgagatgggtttcctgaatagagcacactgatgggtattgactctttatccactttgccagtctgtgccttttaattggagcatttaccccatttacatttaaggttagtattgttatgtgtgaatttgatcctgtcattatgatgttagttggttattttgctcattagttggtgcagtttcttcctatccttgacggtctttacaatttggcatgtttttgcagtggctggtaccggttgttcctttccatgtttagtgcttccttcaggagctcttttagggcaggcctggtggtgacaaaatctctcagcatttgcttgtctgtaaaggattttatttctcctttgcttatgaagcttagtttgggtggatatgaaattctgggttgaaaattcttttctttaagaatgttgaatattggcccccactctcttccggcttgtagagtttctgccgagagatctgctgtaagtctgatgggcttccctttgtgggtaacccgacctttctctctggctgcccttaacattttttccttcatttcaactttggtgaatcttacaataatgtgtcttggagttgctcttctcgaggagtatctttgtggcgttctctgtatttcctgaatttgaatgttggcctgccttgctagattggggaagttctcctggataatatcctgcagagtgttttccatcttggttccattctccctgtcactttcaggtacagcaattaggcgtagatttggtcttttcacatagtcccatatttcttggaggctttgttcatttctttgtattctttttctctaaacttctcttcatgcttcatttcattcatttcgtcttccgttgctgataccctttcttccagttgatcgccttgtttactgaggcttgtgcattcgtcacgtagttctcgtgccatggttttcagctccatcaggtcctttaaggacttctctgcattggttattctagttagccattcgtctattttttttttcaaagtttttaacttctttgccattggttcggacttcctcctttagctcagagtagtttgatcttctgaggccttcttctctcaactcgtcaaagtcattctccatccagctttgttctgttgctggtgaggagctgtgttcctttggaggaggagaggcgctctgatttttagagtttccagtttttctgctctgttttttccccatctttgtggttttatctgcctttggtctttggtgatggtgatgtacagatgggtttttggtgtggatgtcctttctgtttgttagttttccttctaacagtcaggaccctcagctgcaggtctgttggagtttgctggaggtccactccagaccctgtttgcctgggtatcagcagcggtggctgcagaacagcagatattggtgaaccgcaaatgttgctgcctgattgttcctctggaagttttgtctcagaggagtacctggccgtgtgaggtgtcagtccgcccctacttgggggtgcctcccagttaggctactcaggggtcagggacccacttgatgaggcagtctgcccgttctcagatctcaagctgcgtgctgggagaaccactactctcttcaaagctgtcagacagggacatttaagtctgcagaggttattgctatcttttgtttgtctgtgccctgcccccagaggtggagcctacagaggcaggcaggcctccttgagctgtgatgggctccacccagttcgagcttcctggctgctttgcttacctactcaagcctgggcaatggcaggtgcccctcccccaggcttgctgctgccttgcagtttgatctcagactgctgtgctagcaataagcgaggctctgtgggcataggaccctccgagccatgtgcgggatataatctcctggtgtgccatttgttaagcctgttggaaaagcgcagtattagggtgggagtgaccggattttccaggtgccatctgtcacccctttctttgactaggaaagggaattccctgaccccttgcacttcctgggtgaggtgatgcttcaccctgcttcaactcgtgcatggtgcgctgcacccactgtcctgcacccactgtctggcactccccagtgaggtgaatctggtacctcagttggaaatgcagaaatcacccgtcttctgcgttgctcatgctgggagctgtagactggagctgttcctatttggctatcttgtctccaccatcattctgactttagcagggcaatcctcacaaatgccataaacattcttctcttcactcagggttcagtggaaaggaccctaataatagtaggaaaactagtaatagctgccatttactgagagctcactgtgatcacagaagtataatcattaagtctttattttttttagtaacagctttattgagatataatttgcataccaaacagttcacccatttaaagtatacaattcaatggtatttagtatattcacagttatacagccatgacaatcaattttaggacattttcattaactccaaagaaaccctgtacctttggttatcacctctcaatacccccaacctgcccagctttgggcaaccactaatcttactttctatatagatttccctattctggatgtttcatataaatggaattagacaatgtgtggtcttttgtgtctagcttctttcacttagcatgtttttgaggttatccgtgtcatagcaggttgtcagtacttcatttctttttattgccaagtaatatttcattgcatatatacaacacatttggtttacccatctatcagttgatagatatttgcattgtttctaccttttggttattgtgaatagtgctgctattgaatatttgtgtatacctttttgtttgaaaacttgttttcaattcttttgtgtatatacttaggagtgtggttgctgggtcatatggtaattctgtgctccatgtattgaggaactgccaagctgtattccatagtggctacgccattttacatttcctccagcagtgtatttactggaggaaatgtaaaatggtatagccactgtggaatggtggcagtgttgtgtttttgtttttgtttttccttgagacagagtctcactctgtcacccaggctagaaggaaatggtgcaatcttggctcactgcaaactctgcctcctggattccagtggttctcgtgcctcagcctcctgagtagctgggattacaggtgcccacaaccacctccggctaatttttatatttttagtggagatggggttttgccacattggccaggctggtctcaaactcctgacctcaggtgatctgcctgcctcggcctcccaaagtgctgggattacaggagtgagccaccatgcccagctggcagtgttttttttttttttaaacacccatcatggtgggtgtgaagtggtatctcattgtggtttttaggtttgcatttctctgactaatgatgttgagcatcatttatgtacttattggctatttggtacttctttggaggaatgtctgtttggatcttttgcccatttttttatgcttttatttcttaattttttaattttatttttaattgacatataataatcgtaaataattgttggtctttgtattgttgagttgtaagagttctttatatattttagatacaagtccctgatcagatacgagttgcaaatattttcatccattttttgggttatcttttcactttgttgatgatgtcctttgaagtacagaaatttttaattctgaagaagtctaatttgttttttcttttgttgtttatgattttgatgtcatgcctaagaaaccactgccaaatcccaggttaagaaaatttacacctgttttcttctaagaattttaaagttttagctcttaacttagggttttgatctattttcagttaatttttattggtggtgtgtattaggagccttaacttcattgttttgagtgtggatgtccagtttttccagcactatttgttgagaaaactaacctttcttaattgtcttggcacccttcttggaaatcagttgaccataaatgtgtttatatatggactctcaattttattccatttatctgtatgtctctcattaactatcattatgccagtaccatattgtcttgattattgcagcttcatgttgtgttttgaaattgggaagtgtgactcctccaaattttgttcttctttttcaagattgttttgactattttgggttccttgcaattctatataaattttagaatcagcttgtcacaactatctgatctttgacaaacctgacaaaaacaagaaatggggaaatgattccctatttaataaatggtgctgggaaaactggctagccatatgtagaaagctgaaactggatcccttccttacaccttatacaaaaattaattcaagatggattaaagacttaaatgttagacctgaaaccatacaaatcctagaagaaaacctaggcagtaccattcaggacataggcatgggcaaggacttcatgtctaaaacaccaaaagcaatggcaaccaaagccaaaattgacaaatgggatctaattaaactaaaagagctcctgcacagcaaaagaaactaccgtcagagtgaacaggcaacctagagaatgggagaaaatttttgcaatctactcatctgacaaagggctaatatccagaatctacaatgaactcaaacaaatttacaagaaaaaaacaaacaaccccatcaacaagtaggcgaaggatatgaacagacacttctcaaaagaagacatttatgcagccaaaagacacatgaaaaaatgctcattatcactggccatcagagaaatgcaaatcaaaaccataatgagataccatctcacaccagttagaatggcgatcattaaaaagtcaggaaacaacaggtgctggagaggatgtggagaaataggaacacttttacactgttggtgggactggaaactagttcaacccttgtggaagtcagtgtggcgattcctcagggatctagaactagaaataccatttgacccagccatcccattactgggtatatacccaaaggattagaaatcatgctgctataaagacacatgcacatatatatttattgcagcactattcacaatagcaaagacttggaaccaacccaagtgtccaacaatgatagactggattaagaaaatgtggcatatatacaccatggaatactatgcagccataaaaaatgatgagttcatgtcctttgtagggacatggatgaagctggaaaccactgttctcagcaaactatcgcaaggacaagaaaccaaacaccgcatgttctcactcataggtgggaattgaacaatgaaaacacatggacacaggaaggggaacatcacacaccggggactgttgtggggtcggggaagaggggagggatagcattaggagatatacctaatgttaaatgacgagttaatgggtgcagcacaccaacatggcacatgtgtacatacgtaactcacctgcacgttctgcacatgtaccctaaaacttaaagtatattaaaaaaaaagaatcagcttgtcaatttctacaaacaagctagctgggattcttgtacaaattgccttggatctgtggatcaacttgggaagtattgatatgggtttttttttctttctttcttttttttttttttttttttgacggagtcttgctctgccaccgaggctggagtgtggtggtgcaatcttggctcactctaacctccacctcccaggttcaagtgattctcatgcctcagccttcctgagtagctgggattacaggtgtgtggccaccacaccagctttttttttttttttttcgtatttttgtagagacatggtttcactatgttgggcaggctggtctcgaactcctgacctgaagtgatctgcctgcctcgactcccaaagtactgggattacaggcttgagctactgtgcccagcctgacatcttaacaatattaagttttctaattcatgaatatggatgtctatctatttagatatttagttttttgaatggttttttacagtttccagagtataagttttatgtttgttaaatttatttctaagcattttcttcttcttgatactattgtaaatggaattgtttacttaatttcattttcagattattcattgcaagtatacagaaagacatttgatttttgtatattgattttgtgtcctggaatcttgctgaagttgttcgttctaatagttttctgtgtgtattccttaggattttctctatataagatcatgtcatctgtgaatacagatatttttacttttccaaactggatgacttttatttagttttcttgcctacttgccctagctacaacctctagtataatgttgaatagaagtatcaagagttggacattcttgttttctccctgatcttagggggaaagtatcagtctttcaccatcaagtacgatgtttgctttgggtttttttgtagatgccctttatcaggttgaggaacctcctttctattccttgtttgttaagtgctttttatcatgaaagagggttagatttagtcaaatgattttcctggatcttttgagatgatcatgtcgtttttgttttctattctattaatgtgatgtagtatgcaaattgaattttgagtgttaaattaattttgcattcctggtataaattccacttgtttatggtgtataatccttttatatgttgctggatttggtttgcagtatttggctgaggatttttgcatctatattcataagaggtattggtctgtagttttctagtggtgtctgtctgttttcgttatcagagtaatactgacctcatataatgagttagaaacttcacattttttgtgtttctttgaagagttaatgaagaactggtattaattattgtttaaatgtttggatggaattgaagccatttgggcctggactttactttgtgagtagtttttgattattgatttgatatcttgttataggtctattcagattttctgttttcttcttgagtcagttttggtagtttgtgtcttcctaggaatttgtccatttcatctcaattatctaatttattgacattcaattgttcataacgtgcctttaagtgtttttgagcatactaatttgttgaatcttcacaataagcctatgaaggagatattatgatcctcattttataggtgaaaaaaactgaagcacagagagttaacttgcccaaggtcacccagtcagtaagttggaggagccaggatttgaatccaggcagtctagctccagaatgcatgttcttaccatagctagactatctaaagatcttctctaaaagttatcaggagggacctggaatctatctggtcaagcagaaccttttgaagcactttttttttcttaacaaatcagtggtttttcattctattcctggatttgtacagctatcaccactatctaattttagaactttttcaataccccccgtccactaaatccatacctattaggagttcttttcccttcctaatccccctttctactcctacccctgtcccagcctcaggaaaccactagtctactttctgctgtggatatacctctatgggtatgtccattttgcatatttcatattgaactaaatcatatgatatctggtctttagaaggtatttactcctgctcagattggtgattatatctgcctgaaattctctctcttcttattctgaactttagtctttctgtgattttgtctcactagattcatcactctaattgaatatacaatcctattcaaaacaaagctttgcatctggcacatgtgacaagtttctattttgagctttttattacctccattgggaaaacatctccttaatagtccagggtgaggggaatgtagttagattctaccaaagttaattaccagcccatctctctcattagccttcaaacaatgttaatttcaacctgaagtttaccagctgccttgggttgatagacaaagacaaatgcagctagtgaaggagactgatgtatgaacaagtaactcatacaatgtgataagtattataaaagcctttgtatataaggtaatgaagcatatataagaaagcataacatgaatttctatggaaaaattatagaaaagtgtaggtatctaggccatagaaactatacagtgtactacttaagttgattgaccatggtacctactgattttgtccctctaatctgtcttatggggttgaagccccttcccctttcatacctttagtaaatatagcaacaaaaggaaatggtaggtgaggattctaggaactacatttttcttacccagacattgtttccttcacaggcataagctggaagtcacaccagtagtagcctctactaccgtggtaccaaacattatggagaaaccactcattctagacatatccaccacctccaaaacacccaacactgaggaggcatctctcttcagaaagccattagttttaaaggaggaacccactattgaggatgaaacccttatcaataagtcattatctttaaaaaagtgctcaaatcatgaggaggtgtccttactggaaaagctacagcccctgcaggaggagagtgacagtgatgatgcgtttgttatagagccaatgacttttaagaagacacataaaactgaggaggcagccatcaccaagaagacattatccttaaagaagaagatgtgtgcaagtcagcggaagcagtcctgccaggaagagtcgttggctgtgcaggatgtcaatatggaagaggattccttctttatggagtcaatgagttttaagaagaagcctaaaactgaggagtcaatccccacccataagttatcatctttaaagaagaaatgtaccatttatgggaagatatgccactttaggaagccaccagtattgcagacaaccatctgtggagcaatgtcctccattaagaagcctaccactgagaaggagacacttttccaagagctatctgtattgcaagagaaacacaccactgagcatgagatgtccatcttgaagaaatcattggccttgcagaagaccaactttaaagaggattcccttgttaaggagtcgttagcctttaagaagaagcctagcactgaggaggcaatcatgatgccagtaatattgaaggagcagtgcatgactgaggggaagaggtcccgtctgaagccattagtattgcaggagatcacctctggagagaagtcgctcattatgaagccattgtccattaaagaaaagccatctactgagaaggagtccttttcccaggaaccatctgcattgcaaaagaagcacaccactcaggaggaggtttccatcttaaaggagccctcgtccttgctaaagtctccaactgaggagtcaccttttgatgaggctttggcttttacaaagaagtgtaccattgaggaggcaccccccaccaagaagcctttaattttaaagaggaagcatgccactcaggggacaatgtcccacttgaagaaaccactaatattacagaccacctctggagaaaagtcacttattaaggagccactgccctttaaagaagaaaaagtgtctttaaagaaaaagtgtaccacacaagagatgatgtccatctgtccagaactgttggactttcaggatatgattggtgaagataagaattctttctttatggagccaatgtcatttaggaagaaccctacaactgaggagacagtacttaccaagacatcgttgtctttacaggaaaagaaaattactcaggggaagatgtcccacttaaagaagccactggtcttgcagaagatcacttctgaggaggagtcattctataagaagctgttgccctttaagatgaaatctacaacggaagaaaagttcctctcccaggaaccatctgcattgaaagagaagcataccaccttgcaggaagtgtccctctcaaaagagtcattggccatccaagagaaggctaccactgaggaggaattctctcaggaactattttcattgcatgttaagcataccaacaaaagtgggtccctcttccaggaggctttggtcttgcaagagaagactgatgccgaagaggattccttgaagaacttgttggctttgcaggagaaaagcaccatggaagaagagtcccttatcaataagctattggctctgaaggaggagctttctgctgaggcagccacaaacatacagacacaattatctttaaagaagaagtccacttctcatggaaaagtgttcttcctgaagaagcagttggctttgaatgagaccatcaatgaagaggagttccttaataagcagccactggccttggaggggtatcccagcattgcggagggggagaccctcttcaagaagcttttggccatgcaggaggagcccagcattgagaaggaagctgtcctcaaggagcccactattgacacagaagctcactttaaggaacctttggccttgcaggaggagcccagcactgagaaggaggctgtcctcaaggagcccagtgttgacacagaagctcactttaaggaaactttggccttgcaggagaagcccagcattgagcaggaggccctctttaagcgacactcagctttgtgggagaagcccagcactgagaaggagaccatcttcaaggagtctttggacttgcaagagaagcccagcattaagaaagagaccctcctcaaaaagccattagccttgaagatgtctaccatcaatgaggcagtcctcttcgaagatatgatagctctgaatgagaaacccaccactgggaaggagttgtccttcaaggagccattagccttacaagagagtcccacctacaaggaagacacctttctcaaaacattgttggtcccccaagttggaaccagcccaaatgtgtctagcactgcccctgaatccataaccagcaagtccagcattgctaccatgaccagtgtgggcaaatctggtaccatcaatgaggcattcctcttcgaagatatgataactctgaatgagaaacccaccactgggaaggagttgtccttcaaggagccattggccttacaagagagtcccacctgcaaggaagacacctttctggaaacattcttgatcccccaaattggaaccagcccatatgtgtttagcaccacccctgaatccataacagagaagtccagcattgcaaccatgaccagcgtgggcaagtccaggaccaccaccgagtccagtgcatgtgaatctgcttctgataaacctgtctcaccacaggccaagggaacaccaaaggaggtattcatctccctttcttcttaaattagataaattgttctttgatatcctggaggtggctgctagcaaagttgtttttttttttttgtttttgttttttgttgttgttgttgtttttttgccttcctaagcagttgagccatatatagtaagttattgagagtatccctctacctagtgagagggtgatatttcttaggtttacttctggttttatttaatgataggtgatgcagaatcatctcttctcaccttttgtagcctgaggttacccatgatttgggatacatttcccaggttctttggcatttttctcttaagttggccttgtacaatctcttgacttcctgattggcacagtgatagatctaagcaatcagaaagtatttattccagtaatacccacaagagtctggactactgtgctatatacttgggctttgcaatagtggccaggtaatttcattcaggaaattgcctttcttagtaattgtaatttgcatcacggtgggctttggtaaaaaatgggcaaagttcataggagcatctcccaaggaaggtggtctttacgttgtaaatttgaataatgaagggatgatatttagcaagcaggaggagaaatgtcctttttgtagcaaaacatcctgggtaaaggtatagaaaggaggaaaagactaccaagatgaattgggccagatcaaagcattgacataattagggacctaagaagacaggtaacaaagctgaaataataaaataagaatgtccgtcttggagaatcttcagcttacccataaaaagggtcccttgttcctagggcagcgaaggtatatacaatgaagtctaggcatttcttgatccctggaccatatgaggattgcacagccaaggagtactgtgttatggcccaacatatacaaggcttgagacaccttagcagaagaagacagtggggagaaaggagtaatcattgatatgtatgtgctaagtcttccttggaataattctcataatatgtctttttggtgatttctaagcagataaccccacgggaagatattgatgaggacagcagtgatccaagtttcaacccaatgtatgccaaggaaatcttcagttacatgaaagagagagaggtatttaggttgcttgggttgggcaatgatttctagttttcatttcttcatcattccatccttcagtgtgcaagttgaaaggggtggtaataatgatgataaaaataataatagcaacaactaacatattggtagcttactgtgagttggacattgtactaacagatttgtagatattatcttaattctctcagtaacttcatgatggtaggtattattatctccctcttacagatagaggaaactgcccagagtcatgtaagtggtacatggtagagctgagatatgaactaaagtctgattgccttgaagaccataatcctgtacatctaattgctaagaagacagtcttagacacaaaaatggtcaagtagtctctgagtggctgttcttagagatctttttccttccctgtgcatgtttctggcattgtaggcaaaatcgtattctttgtttcatctctccaacctggtgaagttttctttctcctttgaaatctgccagtctcctttaccactaatattcatcaattccaaagtttcttctaactctctcaacagaacagatgggaccaagattatctaccaagcagaatttttagcaggtcatgtataagagggtgggaggatggaaacccacctacagatccacctatcctctttatagagagagtgcaattgattaactgattccaaagcccacactttttctggcatacctaagtaagggacatctttgttataataaaagtgtgagccttggttcagcagtatcagtttcacttgagattttgttagaaatgcagaaacctagccccatcccagaccttctaaatcagaatctgaagttttacatgatccccaagtagtgcatatgtatgttaaagtttgagaagcactgctctacatagcatggtattgtgctttagattgaattgcaaagaaagggcagaacctttttggcatttgtctacagctgtaggtgtgtttctgcccttatttccccctggattcttcaatatccactctgacacttgaatatcacgtgtctatttcccaaagcataactgcaacttgcctggaaaaggatactttgatctgcccctctctaataccagttgaaaacaaggagttagaactatgagggagaagttaattgttaagttacaatgttgaactataagaagagtttatttattaacatttctttctcatcaatgccaggaacagtttatacttacagattacatgaacaggcagattgaaatcaccagtgacatgagggccattcttgtggactggttggtggaggtgcaggtaagcctgacaactcctgccttaaggagctgctgttctctttctcattcagggctgccaggccaaaaacatggtaaaaatgtactgggtctatagagttgaataagctgtggttcctgccctcaaggagctcatgatttaggaggcaagataagatatgcagacaaataagtgtaatacaaagtagaatatactaagtgctctaagaatgtttcaaataagatactgtgagaactaattgaaaggagagactctttctagaaaaggcagtgacggtatggtcgttttatcattcttaaagtcttgtaaaagtatatctagtgatttggactggggtcgatgacaaagtctttcaaactttgagtggaatggataataggaaggacagtgtggcacaggacatggcaggtagctgtttgtccaaggtgagatattgagggaatactgctatgaatacttaattattattttatactaagataggagagcccagagtagtacatagcatatagtagggggtcagtaagtatttgttgaatgaatggaattgaaagaattgctatggagtttgcaaggaaacatacagcatggtcagtctacgctcagcagtcttagtatgtaattaggaagaaaagacaatatagttttatatcctttgttaagtatcagaggagtggttcaggctcattttggggtgacagaccaaggaattgtggtagacacagtatatctgagcatcagcaaaacatgaaaatgtctctcatcttatgaaaatggtagagaacagtaaatcaggtaagagtaaaatttgggtagatcttaaataagtgaaacagaacccaaagattgcttatcattgccaagctggaaagaaatttctagtgactgccattggactttgttctgcttaacattctcattagtaatgtaaatgagaacagagaagatgtattcattaaattcctggatggcaggaaactaggagtagggataggaaataaatggcttacagagaaaaaaatatctctgccagctggaatgatgaactaaatattttttatttaaagtttttgttattgcataaaaatgtacattatagcaaagtaagaaattataattacctgtgatcccacaaccccaaactgctgttctcatttgtttgcatatattatccccccatcttaagcagtggttatccattaggggtgcatctcagaatcagatgcccaggtcctatcccagacttatccaatcagaattgtggggatgtggcccaggcacacatatttttataaagctccacaagttatatcaatgtataccccttgaaagagaatctcagttctagaaaataccatattgtttttataaccttagttatatgtagtgcttttataactctttggttttttattttaaaataaccaaataacaataatgactttttggatataaagttccatgaaattttagcatttgtttggaaataatcaattcataagaaattgaaaaaaaggacaaagagagcctgtatacccttcaccctagtttatcccgaagatgacatctggcacaactatagtatagtgtcatggtcaggaaatggactttgttataatccacagaccttgtttagatttcagcagttttacatgcactcatttgggggtgtgtatagtctatttgatcacatttgtaaataaatatttagtctatttgttcacgtgtacattttgtaatcactaccacagttaaggtacagaactgttccatcgccacaaggatccctcatgccactttttgttagccacaaccatctccctcccctctccttcctgtccctgacaaattatttgttttccatctctataattttgtcatttcatgaatgttatataaatggaatcatacagtgtatagccttttgagcttgatgtttactactcaccgtaattcccttgagatccatccaagttgtgtgtatgaatagttcattcctttttgttgctaagtagtattccatggtacagatgtaccacggtaatatggtttggctatgtccacacccaaatcttatcttgaattatagctcccataatccccacgtgttgtgggagggacgcagtgggaggtaagtgcatcatgggggtgagtttttcccatattgttcttgtcatagtggatatgtctcacgagatcagatggttttataaaaggcagttctcctgcacacactctcttgcctgcctccgtgtaagatgtggctttgttcctccttcacctttttccatgattgtgaggcctccacagccatgtggagctgtgagttcgttaaacctcttttctttataaattacccagtctcaggtatttcttcatagatgtatgaaaatggactaatacacacggtgtgtttaaccattcacctattgaaggacatttgggttgttactagtttttggctattaaggataaaattactatgaatatttgcatacagcttttttgtgaatatagtttttatttctctgggattaatactgaagagtgtgacagttctgtgaatttttagcatatgtattgatttgtgtaactgccactatgattaggaaatagaacagtttgactacgccataaaaacttccttatgttatccgtttagagtcacacccaccttccacccctaactcctggaaaccactaatctattctctatctttgccttttcaagaatattgtataaatgtttgtgttatatgtaaccttatgagactggcttctttcattcagtatgatgcctttaagatttattcaagttgttgcagatatcattagttcattctttttattgctgagtggtattctatggttcggatatatcacagtttatccattctcctgtggaagggtatttagtttgtttccagtttttgatgactgtgaaaagaactgtacattaatgtacaggtttttatgtgaagatatgttttaatttctaatgtcagcacacaggagtgggatcattgggacatatggtaagtgtatgtttaacttaattagaaattgccacagagtggctgtacatcttgcattctcacctccaatgcatgagagttctggttgctctgcattcttgtcagcacttggttttgttagtactttattttaaccatctaataggtgtatagaggaatctcctcatagttttaatttttatttccttaagggttaataatgttgacaaccatacttgtcatgcatatatcctctttgatgaaatgtctattcaagtcttttgcccagttataaataggtagttcgtttccttagtgtcaagttacgagagttctttatgtattctggatacaaatcctttgttggatatgtgatttataaatatatcctctcagtctgtagtttttctttctcttaccagtgtctttcccagagcaaaagtttttaattttgatgaagtccagtttatcaatgccttctttatggattatacttacttctaaggactctttgcctaaacctaggtcaggaatattctgtctctctctctcatgtgtatgtgtgtgtgtgtatttaaatttatgtatgtatgtatgtatgtatgtatttatttatttatttatgagatggagttttgctcttgttgcccaggctggagtgcaatggtgtggtctcagcttactgcaacctccgcctcccaggttcaagcaattctcctgcctcagccttcccagtaactggaattacaggtgcccgccaccctgcctggctaatttttgtatttttagtagagatgaagtttcaccatgttggccaggctggtctcaaactcctgacctcaggtgatccgcctgcctcagcctcccaaagtgctgtgattacaggcgtgaggcactgtgcccgacttctttcctatattttatctcaaaggtttatagttttacatgttacattaaatctatagtccatttttagttaatttttgtataaggtgtgagatttaggtcaaggttctttttttgcatatgagtgtctaattgttctaatgccacgtgtgggaattaaaaactatactttcttcatggaattgtttttgcaccttgctaaaaacagtttctgtgggtctataccaatattctgtttcctttatctctgtgtctcttccttcaccaatatcacactgtctttatttctgtagttttatagttagtcttaaaactgggtattgtgatattttcaactctattcttaaaaaaaaaaaaaaaactggccaggaatggtggctcatgtctgtaatcccaacactttgggaggctgaggtgggtggatcatgaggtctggagttcgagactagcctgaccaacgtggtgaaacctccgtctctactaaaaatacaaaaattagccgggcatggtggcaggcacctgtaatcccagctactcaggaggctgaggcaggagaatcgcttgaacctgggaggcggaagttacagtaagccaagatcgggccactgcactccagcctgggcgatagagcgagactccatctcaaaacaacaacaacaacaacaaagcaaaaaacacctgttttagctattctagttcctttgcctttctatgtaaattttagaatcagattatatcttaaaaatatttctaggagtttgattggaattgaaatatattttgtgcagaaaagagttaaaataataggcctgatactgctatccctagaaaggtctgtttgcaaggttggcccttggctggtaatctggaaacttggccggtaagcagtccccacactgatataaaacttccccgaatgttaattgtggcttactgtgcttaaactctttatgcaaacagtgtggtttaggctgagcacctgctttccttttgggagtctggaacttcagaacatgctaggcacagagtgtttacttgaccagttcccaataaaattttgggcactgagtgatagtaagcttccctggtagacaacactttccatgtgttgtcacaactcattgctagaggaattaagtgcatcctgaagtgactactgacaggactcttggaagcttgcttgtggctttttccagattttgccccatgcttcttatccctttgctgattttgctttgtatcctttcactgaaataaatcatagtcatgagtatgactatatgctaagtcctatgagccatcctaggaaatcattgtgcttgaggtggtcttagggaaccccaatacacatctataggtgagttcagatagaattggcgcgttactatgttgaatcttccaacctatggtatgtctctccatttatttaaattttctttgatttatttttctcatcatatagatcctatacatgttttgttagatttataaaaaatattttcttctcttgaagctattgtaaattatgttttttaaatttagctttctatttatacattgccagtatgaaatatggttgatagttgtgtgttgaccttgtattctgtgactttgctaaaactcaggagttctttttttgtagatttcttggggttatctacatagataattgaatcatctgcaaatggggaccgttttatttcttcctttctaatctccatgctttttattttattttcatgttttattatactgcctgagacttccattatgatgttgatatagatgcagtaagagtggacagcattgccttactcctgatcttaggaggaaagcattgactttaactattagtgtgattttagctgtaggatttttgtaaacacctttgatcaggttgagaaagttactttctatttctagtttaatcctgcgtaatatatttttttatcatgaataaatgttgaactttgtcaaatgcttttttcctgcatctattgatttttttttgttttagcctaatatagtaagttaaatcaattgatcttcaaaaatgggagcaacgttatttttatattcctgagataaaccccattttgtcctggtatatttttctttttaggtattgctggatttgatttgctaatattttgttgaggatttttacatctatgtttatgatggatgtcgggatgttggtctgtagtgttctgattgggttttttgtttgtttgttttttgttctggtatcagaataatagtgatcttgtaaaataagttgggaattatccccaacccttctgttttctggaagggatgtgtagaattgatgttatttcttctttaaatgttggtagaatttgcaagcgaaaacattggagcctggagagtttttcccaaaaggttttcagtgaagaatatcatttctttaatatttataaggttatttaagttatctatttcatattgggtgacttttggtagtttgtggttttcaaggagttggtcccttccgtctaagctgtcaaatttatgtgcatagagtttttcatagtgttccctctttcattcctgatactggtaatttgtgtcttctcttgttttgtttatcagtcttgctagaggtttattaattttattcatctttccaaagagccagattttggtttcatccatttttctttatttttctgtttttagtattcttcatatctgctctaatttttataattttataatttttataattttataactatttaaaaaatagttttctttcttcttgcttatggtttaatttctttattatccatggtgattttctgtgtaataattctgttactgagagaggagtactgaagtcttcaactataattgtggatttgtctatttctaagttttgtcattttttgctttgtgttttttgaagttctgttgttaggaacatacacatttaggattattatatcttctttatatttatttctgactttttcttcatataacaatggttatatgattgcaatcatctttccagtcaaactgatgtatttctatatccattttatttgcagtatggtatttctcttctatcatacccatcctgctattaatggacatttaggttattttcaaatattgctctttgaaataaccctgtagtgaatatacataaatgtgcattttttaacaattttactattgtttctccggaccaaatgactaggaataggattattagatcaaaagatgcacatgaaaaatttttgtacatgttgacagctatccttctgaaatgtcatgaccatttatgcttttaccattactgaatgaaaatgcttattttcccataatcttatcaacaaaagaagttatattttttaccatctgataagtgaaaaattttaatgtgttattttagttagctgtacagaagcactggcattttaagtagtcaagtttatcagttcttataactttaagatttgtttcttgcttaggaaagtcattagtccagaattatataactatttctacaaaattttttctagaatatttatagtttcatttctacttttaaatccttagtctattgggtgtcagaatctaaacaactttctccaatgattatccagttattctaacaccatttattttcattatacactggtttgaaatgacacctttatcataatacttcagtttgtagtctttccaattctcttccattgatctatttgtctactctaacatcagtagtatactgtttttattatatattatttgtctactctaacatcagtagcatgctgttttattattatattattatggctttgtaatacatttattgcctctttactcatcttttataaaatattcctggttgttcttgcacattaattcttccaggtgagctgtagaataattttgtcgagttttcaaaaatagcccattaggattaattcaggaaaaattcacagactttataatgtcgaacttactaagccagttatgttgtgtctatttacttcccaggtcttttacaatttcaatttttaaaaaattttcttcatattggtctcactaacttaaaaatgtttttcttgagtattgagaattttttaaatgttatgagtgttatcctttttcccttttaaaatttattgctagttttttttttttggtccatatgaactttaaagaagttcatatggaaccaaaaaaagagcccacattgccaagtcaatcataagccaaaagaacaaagctggaggcatcatgctacctgacttcagactatactacaaggccacagtaaccaaaacagcatggtactggtaccaaaacagagatatagaccaatggaacagaacagagccctcagaaataataccacacatctaccaccatctgatctttgacaaacctgacaaaaacaagcaatggggaaaggattccctatttaataaatggtgctgagaaaactggctagccatatgtagaaagctgaaactggatcccttccttataccttatacaaaaattaattcaagatggattaaagacttacatgttagacctaaaaccataaaaactctagaagaaaacctaggcaataccattcaggacataggcatgggcaaggacttcatgtctaaaacaccaaaagcaatggcaacaaaagtaaaaattgacaaatgggatctaattaaactaaagagcttctgcacagcaaaagaaactaccatcagagtgaacaggaaacctatagaatgggagaaaatttttgcaatctactcatctgacaaagggctaatatccagaatctacaaataactcaaacaaatttacaagaagaaaacaaccccatcaaaaagcgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtaggactgtaaactggttcaaccattgtggaagacagtgtggcgattcctcagggatctagaactagaaataccatttgacccagccatcccattactgggtatacacccaaaggattagaaatcatgctgctataaagacacatgcacatgtatgtttattgcagcactattcacattagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcgttctcagcaaactatcgcaaggacaaaaaaccaaacaccgcatgttctcactcaggtgggagttgaacaatgagaacacatggacacaggaaggggaacatcacacactggggcctgttgtggggtagggggaggggggagggatagcattaggagatatacctaatgtaaatgatgagttaatgggtgcagcacaccaacatggcacatgtatacatatgtaacaaacttgcacgttgtgcacatgtaccctagaacttaaagtataataaaaaaaatttattactagtatattgggaaacagttgattttttaatgtattttatgttcatctactttgctgaagttagtcatgattcatttaatttactcttgcacttgatatgcttatactttatttacaatttttgcatctttgctcataaatcagattcctttttaagtttctgttgaaggatgctgtcattattaagtgtggtaaagatttaataaaggtctttataaaggattactctagctttttaacataattagggaaattttctggcagtactaaatttaacacaggaattgtattttccttgaagaacttgtccatgaacccatcaatatatagtgccatttttgtgtgtgattctttgagaaatttttataataacaatggctattggcctagtaaggttttcttgcccttcttgagtcatttttgtagtttatattttacttttttgtgtttgtttgttttgttttgagacagggtctcactctgtcacccagactggagtgcagtggcgccaccttggctcaccgcaatctcggctcaccgcaatctctgcctcccaggctcaagctattctcctgcctcagcctccagagtagctgggattacaggcgtgcgccactactgcctggctaatttttgcacttttagtagaggcggggtttcaccatgttggccaggcttgtctcaaactcctgaacctcaaatgatccaccctcttcgacctcccaaagtgccaggattacaggtgtgagccactgtgcctggccttgtagtttatattttcctaaaaatgtatccatttcttggatatattgttattatcatagattgtacataatatcattttataaccctttataatgatttcttttctcactcattgcgtgatgtgttatcttcctcacatgtgcttgcattcatatctacatattcttttcttcaattttcctcacaagcagttttttaaaaatcctctttgtcttttcaaagaaccagctcatgggtaaatatataccttttctgttttaaaaattcatttaacatctgcttttatttttattttattcttgttttgctaaggtttattttgttgttttccctggctgcttgaattgaatgcttagtctgttttaattattcttgacttcataacaaaagattcaaagctatacattttcttctaagtatagttctgagtatatccaattaattttgaaaaatagtgttgtagctatcttgatttttctcaataatctgcagttgcaatttttatttcctcttcgaccctgttttttgttgtttttttagtgcttaacattttaaaaatatttccttttctttgatttatccttttattataaatttctagaggtatttcattgtgtattgaaaatgtgacctgaatgataatttctttcttaaagttaataaggttttcttcatggtttcaggtataataagtttgtataaatgattcactgaagaactgtattctctatagggtacaatgatcattatatcaattttggcttaataattatataatttatatgctaatttattttttctaatttatcaaagcctaagagcagtatggtaactacccacaaatattattgtttagttaatttctcctggcatttcttcacctctgccatcctaccttaacttccttgacttatacaatattttaactgaaaaattccaaaaaggaattttgaggaaagagactttattccagtgaacagtttgcaaactaggagataccagccttcagtgtaaaacaaaggtgtgctcctgagaaaaaaaattaagggtttaggttttccagcaaaggttcacaccaaggttgccaatctggtctatttatgcaaatgaaaaattcaaacttgcttagttctgattggtagatggtatacatagctgagttctgattggttgatacagtggaaccttcattggctggtacagctgaaccctgattggccaaggcaagtgaactccgaaaacctcaaaatttaaaaagtgtgggttttccacagacctctgagcacctatgtgacctctagtcagcaaatggtcacttgactgtattttaaatttaggcccaggtagctactgaggatccatcctgaaggattggctgtttctggtttacatttgttcactgtgtatatgtgcaaatgttcatatatatgtgtgtgtgtgtttgtgtgtgtgtacataataacccttttctcctaactctgtggggtaacaactataaattgtttagggtgtatccttacagatcctttattatatgtctcatcacttttttaaagttttttttttattatcctttcttttaaaatcctaagttatatgagcaatacatgaaatatagcttttaatgggtgtgggttatatgatatttttgttgtatgaataatatgaataggttatgctgtacacattgctttgcaccttgatttttaggaataagtcttagtcatctttccatataagtatagatctatgacattcttttaaactgcagcatgatatccttttatgtgaatatagtgtttattttgttaaccaactcttttgatagacctggtctgttaatttcccctcaagtaagctgagataatttgcatattttagttcattccttcttctgattttagttaaaatagtctagggttttagatccagattatatgtaatatattgtcttccctatggataattatttttgacatttctagatgtgagcctgttttccttaattttgtctggtatattgtgagtcctttcagtctaaaagttcattatttctttgactcagataaatttttatcttttattttttgacattattacccgtcttccttttctcttcgtgtgtgtatgtgtgtctccagaatttattccctcaagtttttattcattatcttcaactttcttttatctcttaattctgggagaatttcttaagatagcctttggaataattgatttggttttggcagtatctaatatgctgttcactgcctctgttacattgcttaaattagttctttttttcatcagaaatcagtctttctggattccagaatgtcgtcttttcatagattcagtgtcctctcagaccttgttgagggtgtactctttaaaagtatatttcagttctttggagcaaaaagattgcataaatagacacttactctgattcttcaggatttttctcctttaaaaattacttgttcttttttcatacatctggttgattttctctgtttgtatttgtagaaggtgatctttgagttttggaatttgaggcagattttatcagatttgtctcctagttcaagactacgagtactctttatatgttctatagttttgatttatttgttactttccttttgtttcttcttacccatctctagacagggaaagcagttgtttctgaagaattggaagagtgttctaaccagaagcacttgtgaggaaaggagagaatcttgctaatgtgctgagggacttcttgtccatatttgttgtagctgctttaaattacctggagcactgcccctattttctgaccagcacaaagacccttgtttggagcctgatgctgagagggctgaaaaccatatcatgtgaagaatagttagaggaagtcaagttatttgttctagaatgggaaagatttataggagacataataactatcttcagtagttaaagggctgtcacaagaaggattagacttgttctatgtgtttccaagtggtagaattatgttagaagggtatcatcttacattcaaggaaggagaattgctataactgacacagcttgtgttttaaatatttattgactctagatttcgaccattcattcagatataatccacacactttgatgttaccacttgataccaacacgcatgaatgcatgcataagtggccaagtgcctatgtgaggtactaggaggctatgcaagcactagctatggcatttgctcacagaggcattatccttagagaactgctgctttctattcctatcctctttttatttttcataatcaccttactgtaatttcttgatacttaacgtggtagtcattacttttcacatgcatgagctcgtcccatccctttctcttgacattcctttagacagtgtgataggcagaagaaaaagtccattttctaatccatagaacctgtacatatgttaccttatctagtaaaggggaattaaggtagcagatggaattaaggttgctatcagcttaatttaagatatgcaattatcctcgattacccaagtgggcccaatgtaatcacaaggatacttaaatatagaaaagggaggcagagagtgatacaatgtgagaacaacttggctggctattgctggctttgaaggtggaagggcccacaaaacaaggaatgcaggctgcctctagaagctagaaaaaaaagaaaattgattctttactagaacctccagaaagcaacacagccttgatgacaccttgatttttaacccagtgagactcattttggccttctggcctctagatctgtaatataaagaattggtgttgttgtaaggcattatgtttgtggtaatttattatagtactgtgttagatcattgtcacattgctataaagaaatacttgagaccgggtaatgtatttaaacaaaaaagaagtttaattggctcacagttctgcaggctgtgtaagcatgatgctggcatctgctcagcttctggggaggcctcatggagatttttactcattgcagaaggtgaagcaggaggaagcacatcacatggcgaaagcaggaacaagtgggggaagtgccatacacttttaaacaaccagattttgcaagaactcactatgatgaggacagcaccaagccatgagggatctgtcctcatgacccaaacacctcccaccaggccccacctccaacactggggattacaattcaccatgaaatttagaggggacaacatccaaactatatcatttcacccctggcccctcaaatttcacattcttctcacattgtaaattacaatcatcccctaccaatagtccccccaaatcttaactcattccagcatcaagtccaaagtcttatctgagacaaggcaagttccttttacctatgaacctataaaatcaaaacaagttatttacttccaagatacaatggaggtacaggtattgggtaaatactcccattccaaaagggagaatgaacgaaaggggctataggcccccacataagtctgaaacccagtagggtttaaatctcaagccgtgtcatttaatcttaaatgtattaaagtcattacatcttgaagctccaaaacaatctcctttgactccgtgttccacatgcagggcacactgctgcaaggggtgggctcctaaggctttgggcagctctgcccctgtgactttatggggttcagccccggtagcttctctcatgggctggagttgagttcctgtggcttttctaggctcaggatgcaagctgcccatggctctacaattctggggtctggaggatggtggcccccttcccatagctccactaggcagtatcccactgcctagtgggactccagagtggggactctagtgagggggttcaaccccatatttcccttccaaactgccctcataaaggttctctgtgggggttccacccctgcagcaggattcagcctggacatccaggtttttccatacatcctctgaaatctaggtggagggtgccaagcctccttcactcttgcactctgtgtgcctacagacttaacaccacatggaagctgccagggcttatggcttgcaccctctggagcagcaggcctaagtaactgggcccctttgggcccctttgaactgcagctggagcttcagggatgcggggagcagtgtcctgagtctgcacatggaagcagccccccactcaccctcctaggcctctgggtctgtgatggaaggggctgccttgaatatctctgaaatgctttaaatgcctttttcccattgtcctggctattagcacttggctcctttttagttatataaatctctctagccagtggttgttcctaagcctgcttggattctttccctgaaaacagtattttcttttctaccacatgaccaggctgcacattttccaaacttctgcactctgcttcctctttaaatataaactcccaactttaagtgatttatttgctcctgcatctgagtgtaggcttttagaagcaggcaggccccatcttgaacacttttctgcttagaaatttattctgccagatatcctaggttgttactttaggttcaaacttccacagatccctagagcatggacacaatgtagcaggacgagtcgcagacaagaacccctcggacaccgagttgtggaaggaaagggctttattcagctgggagcatcagtggactcaggtgtccaaaaaccgagctccctgagtgagcaattcctgtcccttttaaaggcttacaactctaagggggtctgcatgagagggtcgtgatcgattgagcaagcagtgggtacatgacttggggctgcatacaccagtaatcagaatggaacggaacaggacagggattttcacagtgcttttccatacaatgtctggtatctatagataatataaccgtttaggtcaggggtcaatttttaactaccaggcctggaatgcagcgccagactgtctgactactgatttcacttctgcctttaactcctacttttcctttgaggcagaaattggtcataagacaatatgaggggtagtctcctcccttactacccacccctttgagaacctcactcattagtgggagttctcactttcttcctcactacctacgtcttcttgcaagacagatcgatagtgattcatatagaacacttgtgctgaagcattttggtgaactaaggtagcgatgaagctttttatcacttgaagaagtacagggagtagtaagcaggttcctattactattataactcctattataagagttttaaatcctcctaggtctgggaaccattttccaaacatggccccaagatcaaatccatgccacacttgcatgggcatatgtgccagttttgtcatatctctatgtcttcaactacttgcccttgatcatctatgtgtagacagcaattagtaaggttaaatttcctatagacctctccttcagctgctagcaagtagttgagagccaatctcttttgatagatagcatttcttatctgagtttcttgccaggccagaatagtcaaggctctgttggttttattagtgattatttctaagacagcttgtaactatatgatttggttgaacatgtaaatgggggtccggtatccccacaagtcatcttgtgcccacgtagcaggcccataatattgtatgattctctcgggaccattcatcatctttctaatttcctatagctatgcttctctttttgcgggaagcatggacagagggcagcccgggagtttgcctgtttttatgggcagtaggaagaaagatggtttaataatgccaataacacaactacctgcccactggttgggtaatttggcataagctctatgcccacatatccagtaaaatccagtgggcgccgtccagtcccggtgggactccaggtggatccacacggtttgcaactttgggaatttactaaatgtattcctttctgtgtgatttgaactccaccaagtgactgtttttgtggtaccattatacagtttctgtcccagacaactaagtcatcctacggggtgagtgaattcttttccctctctagctatgcaatattgtccaataattgaggcttttaggatgcagaaattatcagggtgattcttctgagccgggaattaatcaggaactgggtctgtaggtactaattctcaggcttgccatggccattggtctcccattacaattcctccacatacataacatgaagtgacattgagagactgggctacatgctcggctaattgcaaaaacaaatttcttgtttttcctggaatttctggtactggcacatgtagttcatcatagaaagtttgaaacattggctcaggagagcgtttgtaaacttctcctcgaactaagatatttactcgaggattcagtctggccccactgattcctaaggccacacgctccccttttttccagcgagaatcaaggggattggttattaccagctctaaggggttacattgtcccttagtacaggaagagccactttttcctttctgaaggtggactggatccttttcatttttttatccaagtggcccaaatgacacaagaccagtatccacattcatttacacacagtcctaattcatgacaaatgtacttattttcagtcatatagcctttttcccaatcaaaagagccacatccccttcctaacttattgctattaatgacagcacaggcatcaaatttcaagattatgcatttgggcaccctttttcttctgttttggctaatactttacttatatcatttacgagtccccacctgtcttcagtccttaatcttatttcaaaaactgtggacatgggaggcttagaggggtcataacacacatctggctggttgtttcctgggctacataccttgtactgagtgtcattatataaacatgttccttttaaagttcctaggcattcatagtaactatagaacagaaagattgttttaacttgttgccctacctcggtaacctgatgtatacactgacagcagtcctcaatgtggggaaaatcagtggaggtttttactatacaagtccaaattataaggaaaatgagtcccacgatgatcctcctcatgcttcggctgtgcgtagaccagtcagcttccgggtgtgactggagcagggcttgtcgtcctcagagtcactttgcaggggttgtccaggcttggtttcgcctcccagatttcattggctgtggtggatccaggctgggattccttctacctttacagccttgggggtggtcaggatgacggtctgaggtcctttccactgtggccgcaaaggggctacattccaatccttcatccacacgtggtcacctggagagaaagggtgaactggggagaataagctgatgggacatttctcatttacccaagttgaaatagtttgtgtaatttttcctaaagcctgtagctgtcgctgtaattcaatttcacctaactctcagggagtgcctggaagcccccccgtagtataggaggaggcctatgatacagtatttcataaggggagtatcctgttttcttagaaggagtacatctaattttaaacaataccataggaagggcctgtatccactttaatcctgtttcctgacatactttccctaaactatttttgatagtccgattcattcgctccacctttccggaactctgaggtcggtaggcggcatgtagcttccaagtgatttctaatgcctttgctgtcttctgtaccaagtcagccacaaatgctggcccattatccgagccgattcataagggcagtccaaacctaggaataagatctcagagaagcacacgggttacctcgtaggccttttcagttcgtgttggataagcctccacccatccagagtaagtacacacacgaaccagcaagtacctattacctccacattttggcatttctgtgaaatccacctgaagatcctcaaaaggagccgctccataagcttgtatgctgggtggaacagtggggccttgcctcgcattgtgctgttggcaagtaacacactgttgttgtgttacggctttggcaagtgctggcaactgtgagatgtagaagtaccggcccaacaatttttcaagtgactcttgacctggatgagtggtttcgtgcatggccaatacaattgtggctcccagcaactgtggcacagctactctcccatctggcagtctgatccatcctccttttattacttaccccccttctgcatggaagaagtctttttcttccttagaataggtaggtaccaggtcagatgtttgagggagtaagggggctgctaccaatgcctggtaaggggtagatgctgcttttcaagcttctgaatcagctcgagagcttcctaaggccactgagatggaggctcgctggtgtcccctgcagtgcatgactgccaccttctgaggtttccacactgcctctagtaattgtagaatttcttgttgatattttatgtcctttcccccagagtttagcagacccttctccttatataatgttccatgcacttggagggttagaaaggcatatcgagagtcaatgtagatgtttacagtcttaccttcactgagttctagagcccgagttaaagcaatgagctcagccttctgggctgaagtgccctgtggcaatggtttggcttcaatgacagcatccaaagttaccatcacatatcctgcacatctttctccttgtgggttgatgaagctgctcccgtccatgtataactcccagtctactgatgcccatggctggtcccaaaggtcaggtctgctagaataaactgagtccaacacctctacacagttatgctctaccaggctctctgatactaggagcagggtggcgggatttagggtgttacagacttcagtggttatgtggggattttcacacagcaagctttggtactttgttaatctagcatttgttagccaatgatgtcctttggttttcatcaaagttaccacagcatggggggcctttatattcaggttttgcccaagggttagtttatctgcttcttgtgctaacagggctgttgctgccagggcccttagacatggtggccagactttggaaaccccatctagttgttttgagagatagaccactggccttggccagggccccacagtctgggttaaaactccaactgccattttttctctttctgacacatagagtgtaaagggctttgtcaaatctggtagtcctgggactgggggccgacataagtttttcctttaacttacaaaaggcttgctgttgtagaggcccccattcaaaaggctcccagtcgcctcctctgtaaccctgtacaaaggtttggctagcactgcaaagtttggaatccataatctgcagaaccccacagctcctaggaattcccttacttgccttctggttttaggttccggtaggctgcagatgacctgctttctttctgactccaggctgcgctcccctttctgaatagtgaatcccaggtagtgtacctgctgtctgcagatctgagctttcttcttggacaccttatacccacagtcctccaggtgccaaagcagggcatccgtcccttttgtgcacccgactgctgtggagtgtcccagcagaaggtcgtccgtgtactggagcaagcctaggtctttagcaggaaacttttgcaggtctcaagccagggcctccccgaagatagtaagggagttcttgaatccttggggaagctgggtccaagggtactgagtagtgacacctgactccggatcttcccactgaaaggcaaacagcttctggctttcaggagctagtctgatgctaaagaaggcatcttttaagtccagacaggtaaaccagctgtcctcagcctgcagcagccctaacaatgtgtaaaggttaggaactgttgggtgcagagtcactgtagcttggttgaccaagcacaagtcctgtactggctggtagtccttggtccctggcttagggacagggaggaaggggaggttccatggagactggcaaggaactataattccaaaggctttcaagtgcctgagatgaacctggattccttcgagagcttctctgggaaccggatactgcttttgtctaattggctgggccccaggcttaacttctatgagtacagggtcttggttgaccaccagtcccggaggattatcatccgcccatattcggggccatcgcttagctagagctggttttatctcttggcctggctcggtcagaaaaagtctccattctttttccctggtgaccataagagccatgataactcctgtttctggtaagtttagctgtaaagagccctgttttgtaaaggagatggtggctctcagcttgctaagcaagtctcttcccagcaaaggcaagggacagtcaggcatatacaagaactggtgaactatttcatgtccccccactgagaaggtccatggtagacagaaagcctgcttagtggaaactcctgttgctctgattatatcaatggtttccttggataagggggtgaccagggtggtcactactgaatgttcagtaccagtatcgaccacaaacttaatgtccttgcccccaattgtaatcctgaccgtgggctccttgggggcgcttgagccgggtccccttcagtctaattgcccttcagccagattgaacaaagctcccttgtctttttctgaggtcttttgctccgaatcaccttgcttttccttcagttggggacacttatctttccaatgtcctatttccttacaataggcgcattggttacattgcagcatgggcgattagattgggtattcttcctggaacccccctttccctgtccttttgggggaattcccctaatggccgcagccagtaagtcggtgtttcacctggcctggcgttcgccttccttacggctttctctggggcttgttgcatctctattcacaaacacttgattggttatttccagtaactgcgaggtattcatacctgcaaacccagcctgtttctgcaattttctcctgatatcttccacactttgactaaggccatattaatcattctctgattttcaggactatctggatcaaaaggagtgtacatacggtaagcctcacacagtcgttcatagaattgcgctggactctcctcttttccttggatgacctcagagaccttatttacatttgtatccttttgagcctctttctttagaccttctatccatgccgcatggtactgtcttagcctctccatgtctggccccttgttcaggtcccactggtggcctgttcctggcagctgaattcttctatattcttgagggttttggtaattggctaggacgtgctcctctagccacttagttgccgcctggagcacccttcacctttcatctgtattaaagaggtacatgagcagctggtggcaatcagcccaagtaggattatgagtctgtataatagtttggagcaagtcaattaaagcttgaggcttttcggtgtaagttggagtattatttttccaattgaggtcagcagaggtgaaaggttgatacacaaaggctgccttttcaccatgtgtctgtcctcatctaccccagtatattgctgttctctcacgggcatttggatttcagtcttgggccgtaagtgagctgccaagggaggagtttctcccatggcttcacttcttcttttgtctactctgggtggtctaggagtatggatatctggtggaagtggaggtgctgtgggctcaggaatggggagcccttcctctcgataaggaggaggcactgctggtaccaattcctgccatgattcttccggtgttggctcggacaggacttttggtgccgacttccctcggtgggtggagtgacagccttccttaactaactgtccctttgctactagtactgctgctgcctgtcctcttaaccactgtgggggatccaaaactagctgtaaccaagaatctatatacgggaactgatctgggtgccctggcttacaggttcccctgtgccataccttcgagacaagggacctgtccaggcttccttctgatggccaacccacctctaatgctggccagtctatctcacacaaagttctaagttttcctggtgtcatagtaactccatagtctcccttaaatccctttttgaaatttttcaacatagttcctagtgaggtgggcttactttgtgcctgacctatgtttccttgagacaaaacaccatgctcacaccacacgcacaccacaaaacagaatgggtaaagagggcacacacacacttttacagtttataccaaaccagaatcaaaaccaaaatcagagtatcaagaaatcccagccaggtcagaaacaaaaccaaagtatcaagtaatccaagtcaagtcaaaaacaaaaaccaaagtgccagtgcaggcacgtcatgggtgattaggccacgcttccactcaaatggaggggtaagttccaaagaccagtcttaacaagttccagatgtccagactccaagtaccagttccttcctggtgttcagccactgcattgatcctccacaggcacctgccatgcactgctctggtgaggcgttccactggggcaattgcctacccgggagcgctctcaggatccacgttgctcaagctggctggagtcccccacagggatgctccacagggcaggcctaagccgcctaaggggctgccttgaccgtccattaatcacctcacttcccagtcagggaaccaagaaatgtagcaggatgagctgcagacaagaacctctcagacaccgagttgtggaaggaaacagctttattcagctgggagcattggtggactcatgtctccaaaaaccgagctccctgagtgagcaattcctatcccttttaagggcttacaattctaagggggtccatgtgagagggacatgatcgattgagcaagcagtgggtatgtgactgggggctgcatgcactggtaatcagaatggaacagaacaggacagggattttcacagtgcttttccatacaatgtctggtatctatagataacataaccagttaggtcaggggtcaatttttaactaccaggcctggaatgcagcgccaggctgtctgactactgatttcacttctgtcttttctttaactcctactttttctttgaggcagaaattggtcacaagacaatatgaggggtggtctcctcccttaacaatatagccaagttctttgctaaggcatataacaagggtgacttttgctgtagtttctaataaatttttcatttccatctgaggcctctttagcctggacttcactgtccatgtcagtatcagcattttggttacagccatttgacctgtctctaagaagtttcaaactttccctcatcttcctctcttcttctgagccctccaaatgtttctatcctctgcccatttcccagttccaaagttgcttccatattttcaggtatctttatagcaatgccccactctttgataccaattttctgtgttaggcaatttttgcactgctgcaaagaaatacctgagactgggtaatttattctaaaaagaggtgttaatccaaaatatctgagacaggtctcagtcaatttagaaagtttattttgcttccatgacacagcctcaggaagtcctgatgacatgtgcccaaggtagtcagggcatagcttggttttatgcattttggggagaaatgagacattagtcaatatatgtaagatgtacactggttcactctggaaagatgggacaactcgaagtggggagggggcttccaggtcataggtagataagagacaaatcgttgcattctttcgagtttctgattagccttaccaaaggaaccgatcagatatgcatttatctcattgagcagagggatgactgaatagaatgaaaggcagacttgccttaagcagttctcaccttgacttttctctttagcttagtgattttggggtcccaagatttatttttcttttgcagaggcttggctaggtatgatggctcatgcctgtaatcccagcactttgggaggattgcttggggccaggagtttgagatcaacctggtaaacatagcgagatcctgtctctcaaaaaagaaaaaatagaggtttgattcacagatctgtaggatatataagcatggcactgctatctgcttggcttctgaggaggccccttcagggagcttgtacttttggcagaaagcaaagcaagagcaggatgtcacatggcaaaagcaggggcaagggggtggggtaaggtgccacacacttttagacaaccagatctcacaagaactcactattgccagaacagcaccaagccatgcaggctccatccccatgacccaaacacacctcaccaggccccacatcccacattggggattacaattcaacatgagatatagaggggacaacatccaaactatatcaggcaccaataggaaactaacacagaacaggtttctgagtagatccaaggccatattccagaaacagtaagaactgtttcttggtatttctgttattcagaaatttaatatgtgtattgctgaaccattatatttgaccatcttcggataatcattcatccatgaaaatacacatcaatttctccagtgcttctcattgacatactttttggatcatctaggtaccagtcattaagagtaacctatacaaggggaggtccacttaagtgaaacttacagggagggtaatgtcactcaatataagggagaattttctgttaaagccattcaaaaagagattgggctgtatttagaggtttgtatggcaggatctaaacaactacttggtggagatgttaaagagaacattcatgcattggttgagttgttggataaggacagattttattctcgaatcctaagaacccaagaggttgtgaggaagaagcatcactgaagattggatgggactcttgtgtatagatgtgcaaattatgcctacacaaggtctctagccaaggctgaaaccaccaatagaatctagctcacactttgtttgccaagctgtgcattctggctgtggggctgctgtgccctgaggcaggagtaacctttggctaattcatataaaggtattatctacttgataagatgtaggcttgaagggctgcattcacccaaagaagacactttttttctaatttgcagaaaggtactgcaggggccagcacaaaccatgggactagggctataggagatggtttcttggagttggtgaaggcaagacaaggatacataagaaaaagaaactagaaatcaatagcaggaggaagttggaaaactgtacaaatacatggacattaaacaacgtgcccctgaatgacaaatgggtcaatgaaattaaggaaatcaaattcttgaaacaaatgaaaatagaaatacaacatacgaaaacctatgggataaaacaaaagtggtactaagaggaaaatttatagcaaaattttatttaaaaagtagacaaagatcagccaggcgtggtggctcacacctataatcccagcactttgggaggccaaggcaggtggatcatgaggtcaggagatcgagaccatcctggttaacacgatgaaacccccgtctctactaaaaatacaaaaaattagccgggcgtggtggcggatgcctgtagtcccggctacccgggaggctgaggcaggagaatggcgtgaacccgggaggcggagcttgcagtgagccgagatcgcaccactgcactccagcctgggagacagagcgaaactccgtctcaataaataaataaataaataaataaataaataaataaataaataagtaaaaatttaaaaataaataactttacaaaggtagacaaatatcaaacaatctaacaaagcaccttaaggaactggaaaagcaagaactgctttaacccaaaattagtagaaggaaagaaataataaagacgatggcaagaataaatgaaatagagactaaaaaaaaaaaatacaaaagataaacaaaacgttgatttttttgaaaagataaataaaattgacaagccataagctagactaagaaaaaaatgagagagaacccaaatgaaatcagaaaagaaaaagaagggaaggaggttatattattaatactttaatcccagtctggcttctccagtcccttagctcacttccaaattgtgctattggtgtctgctcccaattgatatattctgatagcatatctagttgggaagagaaagtagtacatgaataaactccatatttcagagctaaataaacatctcctttgggaggtcactgtacaagttggcagcaaatggagaaagcaagaacctaagtattagagatcaaagggagaggatgtgtccactcaaggctctcatagagaaggcagagcatttctctctgatttgtaaggctggtcaactacccaaatgtgtaaggatagataatgccagtgtcctcaaaggcacaggagatatacacaggaacctagctgaagcagtttctgtattcgtagcagagtcccagctagtcaggactgttcttgatgttgcagatactccaggtagctagatctgtctggaggcgactttggagctggacaatatgcagatctgtgtcgtgtgtgtgttcctccaggtgtcctttgagatgacccatgagaccctgtacttggcagtgaagctggtggatctctacctaatgaaggcagtatgcaagaaggataagttacaactccttggtgccactgcctttatgattgcagcaaaatttgaggtgagtctgagtccctatggcctggagaactaatcaagtttctgtccaacccagtgaatgaatatatattcatatatattcattgttatgtgctgcataacaatgttttggtcaatgatggactgcttatactatggtggtcccataagagtataatggagctggaaaagtcctatcacctagtgacatcttatcttttgtaacattgtaatgttacaaaagataactcatatggtgatgctggtgtaaacaaacctattgcactgcaagtcataaaagtatagcacatacaattacgtacagtacataatgcttgataatgatataaactgttactagtttatgtgttcactgtacttttaattgttttattattattttattagagacaaggtctcgctctgttgcccaggccggagtgcaatgatgtgatcatagctcaccataacctcaaactcctgggctcaagcaatcttcccactacagcctctcaagtagctaggactataggcatgcaccacagtgcctggctaatttccagaaatttttttgtaggggtggggtctcatgttgcccaggctggtcttgaactcccgacctcaagcaatcctcctgccttggcctcccaaagcactgggattacaagtgtgagccactgtgcctgacctggtttagagtatactattacttatttaaaaaaaataaagttaactgtaaaatagcctcaggatgtccttcgggaggttttccagaagaaggcattgttgtaggagatgacagctccatgcatattatgacccctgaagaacttccaatgggacaagatgtggaggtggaagacagtgatattaatgatcttgaccctttctaggcctaggctaatgtgtgtgtttgtgtcttcatttttttttattttattattattattatactttaagttttagggtacatgtgcacaatgtgcaggtttgttacatatgtatacatgtgccatgttggtgtactgcacccattaactcgtcatttagcattaggtatgtgtcttcatttttaataaaaaagtttaaaaagtaaaaagtaaagccgggcatggtatttcaatgcctgtaatcccagcacttggggaggctaaggcaagaggattgcttgagcccaagaatttaagaccagcttggggaacaaagtgagaccccatctctacaaaaaaataaagcagattagctgggtattgtggcacatacctgtggtcccagctacataggatgctgaggcaggaggatcccttgagcccaggaggttgaggctgtagtgagctttgttcaagccactgtattccagtctgggtgagagaacaagaccctgtctcaaaagaaattttttttaaagaagaaagcttatttaataaggatataaagaaagcaaatatttttatacagctttatactgtgtttgtgttttaagctgttattacaaaagagtcaaagttttacaaaataaagttacagtaagctaaggttaatttattatcgaagaaaaaatattttttatgaatttagtgtcgcctaattgtacaggtacagtgtttataaagtctatggtagtgtacaggaatgtcccaggccttccattcactcacacactgactcacccagagcaacttctactcccacaagctccattcatgttaagtgcccaatacaagtgtactggttttaaatcttttatgctgtattgttactgtactttttctgtttagatagcctaaacaaataccattgttttacaattgcctacagaattcagtagagtcacatgtgcataggtgtgtagcctaggagcaataggctatataccatataacctgggtgtgtaggctgtaccatctaggtttttggaggtacactcttatctgtgatcttctcacaatgatgaaaatgatgcatttctcttaacatatccctcttgttaagtgacacataactgtgtatacatacatttatttgtacatatatacacatgtgcatacacatcagtgtgtatatgtgtgtgcatacagttacatacatacaaataatttttttctgccgcattttttgtccctcttcccaaagcagagaagctggtgttggttggcaatggtggtgtatttgtttcctggcatcaacaaggttcttccattttctgtctgaagatgtattatgtgggcatccaactaattaaatgggcagttctttttacagcttccttctgctccatgattctctgcctccaccattttcttgttccaccaactccatccccatctagtggagtctcaatctgcttatataacaaagcattgcctaaccagggtgctggagacatttaagagaaaatggcgtgatgttgatggcagtgagtctaaatggtccaggtgaaatagtaatttgggaagtagcagtataaaagtgagtagctgaccttttcttcatgaccataatccatctaactaacctctctgattccccttccttaggtgctaactgatcttgttcaactttcatttttccttcagctaggctagttgtaggaagccttagggtttgggagcagagagttggcaacttttaccaaggatttcaaagaactttagaactgtgggtttgtttctgtgttggctccctccccagctcctgccttcctctcctccccaaacacatactggctcttaccccctccctccctccctgcctcactctctccctccttaacttgctcccttcctcccctccttctttccctgtcacctgcccttcagtgattgttttccctcactcaccaccccactctcctttgttgcccctcactcacctgctcacttgagccctccctcactctgtcccttcgtcctgtgccagcttgcttgctccctcctcccttcctcctgcttttcctcccttgctcactccttcccttgtttcctctctccctccctcacctgctggctccctctttccttccctccttgcttccttcccaggctccctctctcacttggtggatagattcctctctccctggctagtctacaccctccctccctcggtggcttgctctctcctttcctctctttcccttgctccctcacctgctctctccctccctcacctgctttcttccctcccaggctctgtccttccctcccaggctccctctttttcttccttgcccactctctcccttccttttttactctgggtacttcttagcaaatcctgggagttggagcacccttcctctgttggccaggacagagggcccctaccaagtccatggaggaggggtgtcttcctctcacaggattaagaagtacagaaagccttttgtttaggggaggtgtggagatggcatgaggagagaaaggagacagtagccattgcacagagcagcggaagagagaggttcctgccctggtgttgccactagcttgccgtgtgaacctgagcacatcacttttctctgagcctaggtttccttgtctgccaaaccaaagggttggtcctgtctgtcatccaaaaataggggaaaggtgggggaagaaagctgttgcgggcagtaagctgcaggtagggagaagaattaggggccttcctgtgtcctcattgtttctccaaaccaatgtttgacctccagagggcagagccctggaaggtgctccctggacagaggttcttctcaccctcagcctggcctggcccttccttgtctgacctctgggtgcctccgcacactctgcccaccacagacttttgtctctgcttaggttccctctatgcctgtctgcctctccacttctctcactgccaggtaccctgtattgccctcctcaaacatccttactcattccctacactaggacacaaaatacaggcttattttctatctctagctcccatttctgtggcttccttctgtccctccctccagagaaggccttagatttcaacattcgtggttctcagagggcagatggctgctcctaggccctgtgcccccattatgttgcttctggcactgtaagaatccacccccaggaggtcctatcctctatctggtggtggtggtggtacagttttggggcaggcctctcctgtcctttctttggtttactttttctgatgagccactcacatcaaccagaagctgagtctcagagataccctgaagatttatgccaggaaatccttcacccttctccctgctgacttttacctctaagcagaaaggttgggttgtctgtctggttgtcacctcctctcctctccacccataggagcacaactcacctcgtgtggatgactttgtgtacatctgtgatgataattatcagcgatctgaggtactcagcatggaaatcaacatcctgaacgtcctcaaatgtgacattaacattcccatcgcctaccattttctgcgcagatatgctagggtaagagagaagagacacatcttcattctcccactgctgagttagtctcctttatacccagagtagctgccttgagtggtaggaaaggggaaagggacaacaggcagcagggagctttctccttccatccaatctcctaggttaaagcttggcaatctttatgaaatagtgggaggtgggtgggggtgagttgcagatttccacagtgtgcctataaggttttgaagtgaggccagagttggggaggagaaacgtttcttttatcagggagagacacatggaaaactttgtggggggatgctggcaatattctcattctttgcctgagtattggttacaagggaggtcactttataattcattgtattgtgcaaatgagtgcgatgtacttttctctttgtgtgtgtgataggttgtaatttttaaaaaataagtttaaataagaaaagggaaaaggttgttttgaggtatggaacaccttctagggaggaccaggaacagagtcacggtgggaggactttggctctttaaagaatgacccatatagcaaggggggatgtgggccagtaccatacacacagttggtaatttgattaaaatcctaaaggtggcaaatcccactgactgtttcagaatcccccctaaagagtctgtttttgtgggtagggaagatgaagtgagttacggttgcaggagaaaggcacattactcaaacagagggccactgaggctcgggatgatgtaactggagagggagtcctctgcttggtgccagttttctaaattgatttctgagccagtcttctcattgcctttagtgtatccacaccaacatgaagacactgaccttgtcccgctacatctgcgagatgaccctgcaggaataccactatgtccaggagaaggcttccaagctagctgctgcctccttactcctggccctctacatgaagaagctcggatactgggtaaacacttgcgagataggggtataggggtagagatttaaaaagcagaaggtcagctcatggggaaggtgtaaattaaggccacgggaaactcttggggacaaaactgacacatattcaccactgtgaactctaacacctggacaacttggggcaagggcttctacagcaatggttttgaattatgccatttttcataatcaaagtaccctttgttccaaagaaagctcacctgaaagcccaatattacataccagactactgtgaaggtattctggttgtcatatggggtagtgtgaccctacttcttatccccagccctgttcccctcttgcctcttgcaatcccctcagcaagactggcccctgaggcagcttgttggaacagggtttgaaaagcactgagccagagaagagtagtgaaagcaactgtctgtgtctacaaaagtggcactcaggggcatgactatagtgttcttctctgaagaaggctctcaaagcctcctgctccaatacaaataaaactcatatttgatgctttctcaattttatgaaaagttgggggtaaaatcaactttagataatttcgcattcttactaatgatatgtataatatataatccaagtagcaggagtatgcttgcaaatgcagcccctctgctcaaccacttctgagctcctcctacctaaaaatcctggagccactgagggaagaacctctgtgggctgagaaagaaccacataaagtagttatgtgaacttggagaagccatactgaaatttcttgaaacagagaaagcattcaataaatgatagtgatgatgaaaaagaataaataataatcatgactggcatttattgagtgtttagacagtgatctaagcactttgtgtattaactcatttaatctccacaacaaccccacatgatagtaccgttatccctgttttgcagataagaaataactcccatgtttacacagctgatgagaggtggagctaggctttggaaactaggagtggtgttcacaatccaaaccaactgtgtaatcagaatgggcgtggccacagctctggagctgagggtctggaggccccatgctgaaccaggctttgacccttggatcccatggaaatccagtgggccgtgagggggacagctgatgggttcaggcaagcaaactgtgtgccaactaagatagaaatatttcagtgttttcacacttggtgactaaaccagggcatatcagctaaatgtcagcccgaatctgaactcaggtagtctgactccacaatcctctatgttagtatactgcctctcctatagataaggaaggcttcacagaagaggtgacttttgagctgggtcttgaaacgtatgcaggaacttgtgagaggagacattctaggtagagggagcagtaattaaaaagacgtgaaggcattaaggagggagtgtgttgtgtttagggcagaataagacatcccctatggatagaacagagaatatggtaaaaggagaggtgctaatgatgttaatagtgacagatgagaccagaatggtagatcatggtcagattgtgaaagaaaggctttgtataccacgctgagagacccactttacactaaggcattgaagggtttttaggcagggaggtgacatgctcctgtttgtgtattttagaaacagtactggtatagcaaaagagaaggtagagtaaatgagagagaatataaaggtgggaacaccagtgagcaggctattgtaacatagtcaaggtgaagcatttgagggtctgaactgacacagtggcactggggccttttagtcttatttaacacatccagtctactccattacccccttgtgttactcccctactcagcacgccaatgacggccctttgccggtggtggtggtggtttccaaacagtatttgggggagccctgggtttcctgcagaattctctcagggaccatgtaaaagataaagggatccaaatttgtgggcttcttagctcacacccccacttccaggtaagctatttgggcttccaggtaagacacttgaaaaagaggagttcaaggaaaataagacattttgaggaaaccactgacttataaatcctcttcctttctctgtctgttgagctccccacttaaccaaccattgtggacatgctgtcctctgtgaagctttctgtgactctcctgacagagttcgtgggtcctgctgctgtgttcctccagtgtcctatgctcacttccattatagcacttatcacacattttttaactcgctgtttgcacatctgtctcctctactagactacagactcctcaagggcaggtccctcattcatttttgtgttcccaggatcctacatatagggcttggtaatcctagttagcattgtttggatacttactatgttccagactctgttctatgtatgatacacacatacacaaatacacacacacacacacacacacacacacacacacatttaaccctatgatggaattaccgtaataatccccatttggcagattgggaaactgaggtcccaagaggttaattaactggctcaaggccaagctgttaggggaactgaaatttgacctgaagcattttgcctccaggacctctgctcttaaacactgctataccgcttctgccacataataggcattcttagctgagtgagaaaatgaacctgtggaatgatagctgttagagccagagaggaggatcagccttaagttcatgttggctgtggagttggcacctaaactttgttctggggtttacctggccattagctctggacctgagagtgagcaaattacaaaatcagtcccgttccttaggactggtgaatttctgcttacatgaacatctgtgaccagggctaatatcttttttttttttttaagagatagggtcttgctctgttacccaggctggagtgcagtggtgcgatcatagttcactgcagcctcgaactcctgggctcaagcaatcctcctgcctcagcctcccgagtagctgggactacaggtctacaccaccatgcccagataatttaaaatttttttaaaagagatagggtcttgctgtgttgcccagactggtcttgaattcctgggctcaagcagtcctcctgcctcgggctcctaatatgctgagattacaggcatgatccctaccacgcctggccaagagctaatatctaactggtacgtatggatatagccatcccagtagtttgtggctggaatctattcttctatatagcatagtataattattgatcagcgtccagatggtgtgagtctttgaaatgttttgaatgtcatctctgtttaaaccatgtgtgggaagcttagacttgggatagcagagatggaggaacggtgtgcttcctatagtagaaatcactattcatgctgcttcttccaggttcccttcctggagcattacagtggctacagtatctctgagcttcaccccttggtcagacagctgaacaaactgctgactttcagttcttacgatagtctcaaggctgtgtattacaagtattctcacccgtaagtactaagccccggatgaggttgggtttgtgttcatttattgggaggctttaaaatactagaccgagactagcctcacttaagagaaaaagattcaggcacttttcaccttcctttctactctagggttaaagcaagataggaaactaagggctgtatgtcccacttgttccatagagcatgattgtatttgccctattctatgctgaggagacccctcttccttttgcagggtcttctttgaagtcgccaaaatccctgccttggatatgttgaagctggaggagattttgaactgtgattgtgaggctcagggcctggtactctagcagcagccacagggctaagcatgcatgttaacagggtatatttattctatgttcgaatttgtcttttgatcgcttttattcatttttcctttctttgtcttttcccaaactgataatgttataaatatttatgttgcttgtttttatgaaagaaaaaatattgtcatatttgactacaaatttaataaaaaattaatggttattgttaa

SEQ ID NO: 2256 - DNA, 67373 bp, Homo sapiens; identical to SEQ ID NO: 2255

SEQ ID NO: 2257 - DNA, 101844 bp, Homo sapiens
aggttttgagagtttttttagtagaattctcaatgttgtgagttcttccagctttcaagggctacagttgagatctcgatggtgttagaggatcatcaccctctgcttcatcttcacgatgtctgcggtgccataaattgccttcagaggaaaaaaaatggtatagaaataatgaggttagcacaatgccagatgcccaagtatgtggacccaaaagagagcaaaaagtctgttagaagatagactggtttgttcctattgtactaaccatctctgaatcatcagggaaaaccagctgaaaccaagtgagctaaagacaaatgggatgaattttcagaacctgataatttatggaactgatattgactctgtcagagtctttagaaatatttgcaaacactattgtctcccaattgacagactcttaaggaatcaaaccagttcgaccatacctgagaaaatacagctcgatccaagagattctctcttggcattcgtgcaaactcttagttccttgaaaacaaactgctaccctctgtccctttctttttttcttttttttctttctttccttctttctttcatttcgctccctttctttctccttccgtcctttctttattcttcctctttttttctccctccttccttccttccttccccctccctgcctccctccttccctccttcctctttctttcaagatgaggtctcactctattgcccaagctgaagagcagtggcatgatgacagctctctgcagcctcagcctcccaggctcaagcaatcctcccacctcagcctcccaagtagctaggactacaaacgcacaccatcatgccctattaattttttattttttgtagagacagcagggtcccaccacgttgcccaggctggtcttgaactcctgggctcaaacagtctgcctgcctcggccttccaaagtgttgggattacaggtgtgaacctgttccttttttttccatgtccactattactgcatctctcaagcttccaggttgtctaggaccaaaatttaggagggaccaccatttacatcagaattggcacaactgaaaactctaagagaaccttcttttgaatcctactgatatgtcaatagtgcttaaggccaattctgaagaaagaagaaatggaaccaaaattcaaacaataaaatatacagatatgttgcttttctaccacttactataacaggaacaaaagtgtttagataggccacagaacctgttcctgacccttaggagtgaatcaggcagaaaaatcaccgcctgtttgcatttttgttttctgtatatgttatggagaccacacaggttctccccttaccagtgtccatatcactttctctcaccttgtccaagatatggcttggtatcacttactgctgactcccagatggcctcccgcttcatcatcaccattcccacaaacatttctaatgggggcttcaggtccctgggaggtagccaggctgttgggggaagtcttcatgacccctctgcctgtgggggagacttaccaataaaactctggacactctggcctgatttaggcttgcgttcctcttctacctttttctttcccaatttggggaacttaattttcagcctgaggcttctactgtcagtgtccgaagatttttcctgagaaaccacaagaggaaggtcaaaatgttagttgcctaatattcaaagataattgctggagtcctggaaaagtggtaaacaagaatggctacagagaacagggagatctgctctctatccaggtatgagaaacacccccatcactggtcgcatgccctaggaaagcaattgatccttaccaagaggctacttgatgccaggtgctttgctagcattaataaatgctctcatacaactctcaaagcaaccttgcaaagtggttattaacatccctgtatcagagatgaggaagcagaagcttggagaggttaaatatttcacctgagctcatgtggctagggattagaaggatgagattgctagcgccactgctagctcacatggaatctctgcatgaattaggaaaaaacacctcttccttcagacatatagtttggtgagccttggccaaataccttcttatagggaagacccttgcctgccaggccagctgcttccctgtctggaatgcaaagagagttctctaaacataactcttaattatgaacttgggctctctgctgtgcagatcatgcaggctctgtaattccagcttaggcctgctaaagtatgcttgttttactactggtctcagtaaaacacaattttgagattaactttgttgtcagaaaacccagagtgggagggacggaaagcagcagggagaggtaatatttggaagatttaaccaccagtatggcctgggcaccaaccatttagaacaggtattggctgtaaactggcatggccatactggtatgaaccagatgaagttcagtcctggcagcaggtgctgagcagggagggggaatttgcagccaggaaaacaacacacaaaaaaacctatcttgcttattctttcttgatcatctcttgttacagaatgagccttctttctggttatttttccacagtcacctaatttttctacatgttttctgccttaccctatctatttatgatgaagagattggggggaggtgggcagggaggaagctccagtaaccttcagtttaaagccagcactggaccccctgtactacagtcaccatgtcctggcccacactggaagggaaggcactaaggaagaatccctctttccctttatttcccaattcccaagattacgcacctctggaacaaagattggattcatccagtcaatctcagatagctttttgaactccttattcatggcatccagggcgctttgtagtgcagtctcatcctcagcacttctcagctggtacagacaggaaaaagagtaagtgtccaatgcctagcacttttgtagactcttacactctcccccactcccagtccctgctagtgaccaagagaccacaaggtgccaacttgtatccctttggcccatagccagctgttttctttctcaaaaggaatatccagaaaacaaccaaatggtggggctctccttggggctgggcatgcttacagttttgcaagcagagaggtcttttgattagtatcaattaacactgagcttcacccctacagcttagggttgaggacaagggtcctactgtgacctccagtccctggagacatctcagtgttcccctaagtaaaagctacctagctttgagcacatactgtatgccaagcactgtacatacataattttgtcccatcttcccggtaaccttacaataccttacaaggtactattgttttcattccatgggtgagaaaacagactccaagaagtttagtgctcaagatcacacagctagacagaacccaggtctgtttaactgtatagcctgccctctatacaacattgtcttatcaaagacatgtggggaggccagatgctgagggaatctttattacatgcttactgtaatttaaaggttgttttgtgaagcaaggagagagctagagagaggctggctcaactttctcctcctggaaaagagggtctgtctccccaggccatgctttagcccccagctatcactatgactaattaagaaatgagttctagatggcttgtcccacaggttcaggaagcaaatttaagtgctccctagtaacccccagcgcccacaagatgaactttgtacagtccatggaagacttaaaatggattcttttgggaccatcttcgactcagaagaatcaagttctagaacatcaacacaggtgagatggttcacattccagtaagtagtgagctgggagaacagatgggcaaagatatcttcagccctcacatgcttacagcccacctaacctggcctcacctctactccctggcatgcactttactttcaatctagcacttatgtggcttcttgctgtgcacaggccacttgctgctccagccataggttgagccttgctggctgtcacaaacgggtggcatgtgaatgagaggagtacagggtaggaagttatggtcagtcactatgggatactgagggaggagcaagtcagtgccgacaaataatgttttttgcttttcaactagtaacttaagacaatacaaactgccctagatgcacgggacatgtgtgtgccaagtaagggaagtgggagttactgggagggattcacttcgtcatcaatttacttccctttactaactctgagctccttactgccctacttcttcaaggggaggaataacacccaaatgaaacaagctgtatctccatctcacctctaggacagcctttctggagatacatggtcattcttagctgctgcctgcttcttggccacatttggatgtgtggatgtgtatgtgtgtttaagtcctcactgggccctatgaggtgggagacttctcaagtgtggtatgggctcaagttgggttgttggttggtgtgaaccaattttcaggtcatgagcctcgggaaagtggcgacaagagaccaaacgcacctatttcctgctgcccaaatgggcaaggctattgagctctgcctatatatagaaagtacttctgttgatgttgtctgaggctcaaagactagcttggggctcagatgttgggacagtctgacctgattgccttagccactctgcctcctgtgcagtgtgccaattagatgagcaaatgaaaagaggaaatagatgcacttctgcaatatcaactctgaagcccctcttcaaataaaccttaattagatgagaggcaagcacagcacctgcctcagggccttaccagccaaccctaaagtggatgatcataattagtcacctcatcagagcacactcaccaagtatgcctatgggttttgcattctgagaaacatgcaactagccttctagcccaaaaatggagcctcagtctgttctccctagaactaacaaaatgcactatgaagctgctagtataggctaggcactgataggtacttaatatacaacaccctggagaggtagggattataattcctatcttgtagatatggaaactaagacccagagaggtgaagtcacacagctagtgttatgggttgaattgtgtccccccaggaatgacacgttgaagacctaatccccagtacatcagaatgtgaccttattcggaaatagggtcattgcagatgcaattagttgttgaggtcatattggatagggtaggccccaatccaatgtgactggtgtccttataagaagatggccttgtgaagacagagaaacacagagagaacatcatgtgaagatagaggattgaagtgatgcatctacaatccaaagaacaccaaagcttgccagaaaaccactggaagctagaaagaggcaaagaaggaccccttacaggttttagagagaggatggccctgctgacaccttgatttggacttctagcttccagaattgagagacaatacatttctgttgtttgaggacacctagttcttgatactttgttatggcagccttaggaaacgaatatattaatagctagtaagtggcagatttgagatttgaacccaggaatctcccaattttcccactattccacaccaccttctcatagggtgaaagaggcatgtagaaacttgggaggtacaaagcagctcaaaatagctcacctttttctactggagctgtatcaagtacggtaacactctactttttattggcctggtctgaacccacaagacatttaccaaaggagaggttgagactttctctcaagagtatggtagtccctgtggattagcataacccatgaagtcatacaaccaacaacaatcctaggtgacacagtagggacttccaggcaagcacctggccaaaatgctcccacgggtctccagtgcccttggaccaagcacaagaccatgaccatgttcagatagaatactttgccctcccagactccaaccccctgcactcaccagcttttcatccaggaaagctgtggtgtcatcgtagagacctttaagactaaatgtaacatctacggcatcatttctgcttagagtctgagaggaaaagaacggaaaaggagagaaaaagacaaagacaggggagttgttggttagtaagcatgcagctgtcttctccgtgggaaggtagaagcaggctagtaggatgtggctataggtgaaaaagcaatattcaaaatatagtacaactagcacagcatgagctgtactatcagaacgagtgccagctgacaactgctggtacagtagttgtgtagtactatgtgaagtggcagagcacggcttggctttggcatcactgattgattgcagtgggtataggaaaataggaaatatgcaaaccagagggtaaatttaaggctacttgttgtcctaggccaaaaccatcattccagggcaggtgaaattagggcctaacatctctcttcttgcaactccaggccttgagttgtaggcctcctccaactgtaatcaggccctgacacaattatatctttcgcctagcactaaagttactttttaaaagcatcagttaacaattctggcagtggacaaagccatggggtgacacatttaacattaagtgtcctgcctgatatggacctttccctcaagaggaaaaccgaggcacccggaagttctagttccaatgacaggtgttcccttatcaggttatacagagatctacttgtgataaggaagggccaagtacaagtttctcttcgtttattgtccatttctcccttgaagctggtgggagggatggctatcagggaagagggctagctctcaggctgatgaaatctgctgtgattttcccccagcaaccaccttggacctgtaacaagtcaaggaatgcctgccttcccgtccactctctccatcagtttcctgccatatttgcccagtttctccgtccagcctccggctccacttctttccctttcatcctctttcctatctggtttgactcctttccttaattcactcctttctacttacttcaatgggaatacaggaagctgcacccatctcattgccactgtcttggccgtaaaatatatcattcaggatgttagcgctggcattcacagaacccatgaggacagacacatgctggtggatcttgctcaggtcattaagtctgtaataaagcaaggacagatagatgagttgggatttctgaaggacttctggcctggggcactggtgagggtttgggtaagggtagaagtgaaagccctgggtacctgacttggactcatgactccctcctgttatttctgctcttctctaggtagccacctatgctagcaaatgtttctactcttctctaggtatttacctttacccatccttgtctcacctgaatttagatattgggaatttggggagggtagaaggctagaacagaggagggcagctgactctaggaactccaaggccctcctgatatttaagggcaagggtaaacagtcttagttctattgggtttggattagcaacaagagatccaaattaatccctgggtctaatgagagatgtctaacctggcttattgctgagcacagagaatatttcctgcctggattgtgagggtcccgctcaatttttagagctctaagctaaattcctctctgaggccaggctccctagtagccaatagacacaaattggcttcttctccctatgccttcttaggattctcagccctgtatctaggccagtccacttacttgctgatgaggttttctgcaagccgagctaagtgctgcatctgggcatactcctcgtcagagaggctctcttgagagtcctggaagtccagctggggttgaggggcagcttgaatttcagtatgcttgtattcccacattttcattgagttctcaaagtcctggagatgaatacagtggcatatcctaatgattgctgtagctactagtgcacatgacagatctgtctgtgagcctgacgtttgtgggcaatgggtatgtgggtacagtgggtagaggggaaggagggccccctgtccattccccctgtcatacccatctatatacctatacaagtatccatcattttattcaatctcttctggactatgccctttagtttttgttgttctgagtatgctggattttgggacaccaggcttggatcatacacatgtctggtttctagaagctcccatatgaaggcatcatgactgacaagacagtggagcacctttcatgctcccttctttgccaaatgtaggcaatatgtggtgatgcagtttagagccaaacatatctaatttaattttgaatcgtgtttctgtcatttactagttgtgtgaccattagcaaattatttaacctctctggtcctcattttcctcatctgtaaaatgggaataagtgtatccacctcataagattgtggagagaacctacatgagagaaatgtaaaatgcctagcacagaataggcagtttataaactggacttctcttcctttctctattgctgtttccatggacttttcacaggttagagtgcaagataacctccaagcattgaatatgtgatcaataatagctcctttataagctttagaagctttagctgaagtggatgacatgtattaatgcagcattttaaggaaccttagagacacctaaagaccatgttcaatgcagaatctgttgctgaaggagaagatttttccataatcatctgacgcttttagctctctttgcagtggaaagaggaggataaccttgtcgaaaaccaggggaggaagctccttgtctcactctcttggacagtgtttgcaaatgtcagtatatatcagagtgtcttgaggagcctgtttgcaaatttgggttcctgggaactatgcaaccctatgtggttcagtgggtctggtgtgggggcccaagaatgcatttataaccagcatctcaagtgactctgatgccaggggcacacagacctccttttgaggaattctgcttgagtggaaatattcagtactcaagtgactatggatgaggcagtataggagcccaagacaagattttcccccttacccgatctcttgtcagcatctgggcagcgttcttgtatctaattttgataagcctggtctctgaatccaggcctccccatccacctgcactgggataccttcttcaccatcaatggttatcatcacctcatggcactgccagagaaaatgaggaagaatgggagagaaaaatggggcaactgctgtaactctatctgataatctcatagttatggccttgaatgtgtatctgaagcaggactggaaaggatgtgaatcagatcatcccaggaagaaatgcctgtttcctatgggctttttgctccattggcttctgccacctctgcctccaacctcagtcagcactttactgcccaccagataacctgctcactccaccctggcattcttctacccagttaattcctgggactatcccacatcctgggtagcagtcaaaaacctcagccccttcccagtgcccacccagcccctgcctacctgggcaatgcgatgatgatgcaggttgatgatacgggacattgccatctgcacagaaccaaagattgccaccacctccagtttcccatcatcgattgcaggagcctcatattcctgaggaggaagaactgtgtcacatctcccacccttgagaaatcacaccctgtctataacaagaaggcatgtttaaaggctcctggtgagaatttttctagctcatgaagagtggaaacacttcattattaaaagggaaaaagatgaggtcagaaagccaatctgggaaaagggtactgcactcttagccagttccctccttttccaatccagcatcataaatacctgaggccagtcttattggccttatgaccttcttgggtaaactcagagtaaaggggtcatggtcagcatcccaggagattttactgacagaattccttggagaaaagagcatggccttggccgggcgcagtggctcacacctgtaatcccagcactttgggaggccaaggtgggtggatcacctgaggccaaaagttcaaggtcaacaagcctggtcaacatggcgaaaccctgtctctactaaaaatacaaaaattagccgggcatggtggctggcgcctgtaatcccagctactcgggaggctgaggcaggagaatcacttgaacctgggaggcggaggttgcagtgagctgagatcttgccactccagcctggatgacagagcaagactccgtttcaaaaaaaaaaaaaaaaaaaaagcatggtctagatagcctttaaaggatctgtcagacccgaggaatggaaaatccaaagcccaggcaacacctacgagttgaccttatcctgaggtctttggttgaattttctgctttcggatggtaattgcctgaaaaactgatcatacagctgctgctaataaaggttctcggaccacctcctcttctcccattgtctatttttcacttcagttagcacaatgcttccttcagagagaccttagtgggatcatgcctttcttcctccccattccttgttccatactaaccgtggttgctgtgttgcttccccagaagttgatacctccagcatagctggtaatgttgagcactacaatgccttgcaggtttggcaaggagatggtttctccatcacactgaaagaaaagagtagctctcattagctggatctttagatagcaacatgaaggaacatttacagagatggggaaagggctctgtcttctcttccattacatggaaatctatcttcatgccttcctcccatgagctgtgaggatcacagagttaaagctcaggaagaatcagcatgtacggtattcccaaggccatgagatttcctttctccatacccaggaaagactacccgcttttccactaacctccaaatgcactcgttcttccagtttcctgtaagagcgctgcaaaagttctttggttcccagaaggccataccacatcttgttcttaaggcggctactacatggaggtaagcattaagaaagcagagggtgaatgatatatagataaatggtggaaaaagacaggaaggaaaaccatcttacttctcaaatgccttcttacagagaggagtcatgctaaatggcaactggacagcggttaatgtaactgatatccaatgcaaacacttgaagaaatgggttcctgggcccctttgaagcctcagtatcctatcaataaataaattttccatttctgcttgctaccaatattggtccagacttggaagaaacaggctatattcagacatcaatgctcataaaaagctatgagcgtagctggctggtacacaccagctaccctagttgtgctactccaggagatttcagctgcttggaatcaatttcatttgaaacacgtgactcttagagtgcaattttttttgaagcagcaacttttctggcaaagtgaagtacttttccaaacaccagatccatatactaaatgcctaattcaatgccatggaacagatctaagcttgtagggagattttagaggaggagccagtggagaaaaataggagacaggaaaggatatcaggtgacttgaggtggaggtggggaggacagcgtcttgttgactgtggaatctctgatagaaataggtggggcacttacgatcactagaaaggctggatatagtttacttggagcttgtaaagtagagccacagaaatgagccatcatcacatggaatgagttttgaaatgtcagaaggctagcacaaaattattgagacactgtttaaaccattcattctctgggcactttggtgttctcatctacaaaaataggagtttaggtatatgaaaatgtacaatacctagaacaaaccaattctgaaaaaaagaatcaagtgggggactttcatctcccaatttcaaaaactactgtaaagctatagttatcaagatagtgtggtacttgcataggatagacacataaataaatagaacagaagtgagagtccagaaataaacccttgcatttgtggtcaattgatttttgacaaaggtgccaacacgattcactggggaaaggatagctgttttgaaaaatggctctagatccgggcgcggtggctcatgcctataatcctatcgctttgggaagctgaggcgggcggattgcctgacctcaggaattcgagaccagcctgggcaaaatggtgaaactccgtctctactaaattacaaaaaattagtcaagcatggtatcatgcaccagtagtcccagctacttgggaggctgaggcaggagaattacttgaacccaggaggcagaggttgcagtgagccgagatcatgccactgcactccagcctaggcgacagaacaagactccgtctccaagaaaataaaaaaaataaacaaataaataaattaaaatggtggtgagataattagatatccacaggcaaaaagataaacttagactcttaccttagaccctcacactatacgtaaaaattaactcaaagtagatcatacacttaaatgtattaataagagctaaaacaatacaaactttagaagaaaacttaggagcaaatttttaagatctcagattaggcaaagatttcttacagatggcaccaaaagcatggtccataaagaaaaaaactgatcaattggaccgccttagaattcaatacttttgtatttcaaagataccactaagaaaatgaaaagaccagcaagagactgggagaaaatatttgcaaatcacatatctgacaaagttcctgtttctcagcccaggcctgctttgagaaagaggttctagtggtggtggcaagggtggggtgttgtggggtggggtgtcacactttttacttatagcttcaatgtaccacaagaactctgagactgacttaggccttgtctgaagtatgaaagtgcgagaaggtgccatgcaggccaacactggatagggtaaaattaacgggttcaggggaaccaggttaggaacaccaaaaacaaatagagggatgtttgatactttgcaactttgtcaagtgaaaacagatctgaagccactactgaaacctggttaaactttcacagacagaacaaaggtgggcgatttgctaaattgagtcaacataatctgttgtcagtaacagtaacacaggtagctgtgtttacacagaaatccacaggtctggatttgaaggcagctcaagtttaggatgccagtgcagtcatccaaaatttggcacacactgtcccgctagactagtcttggggccaatgcattttacttccagtgggtccctttctttctgttgcttgtctgagaggtagagaatgtaggaatacgtatgtgtattgtgatagtgtgtttgcatgtagggaagggagtttcttttccttacttgtattgccctgggtgttcatctcttctggtgttgaagtccagagaaattttagcatccagtccaattccgaagtagttgttcatgacacatttttctttgaagcgtctgaaattattcaaagaagaggacagacattggtgcaggaaagaagtgccgctatcaattgggcatgaagatgaatctgcatgatggaaaaccagtgagggaaggccccctccacactgggcactaactataacatttttgagaggcacatgtagatatccttttgtgtgaacaactagcttattagctgtaagagggagtgcctcgccagttgggaagcttcagtgggattggaactcataataaagaagcaacattgatgattttagtcatctttggaggccttatgtatgagtggcccatattttcttcatatgtagtattaagggaaatactgtttactcctataaagaacttttgaatatcctagacacaaacgtgccatgacagttaagtctgcacaactgctctcagtgatgtccgacatcaaaggggaaaatgaccacacatttggaaggaaagactgataaaagagggtagatatgtacataacaaaaaagccaaattatttgtcaagtctcctgtgtccatctagggtgtcagcatcaaaaccagtggtgtgccatagccagttggcaccagctcatgtaaactgattatgcatatctctttccaactccagattcaatggcattatatcactaacttaaataggccatggtggaagggtttacaccataaatgaatcagggctttctcccccaagagaggaggttgttaaacactttgccagtgcactattgatcaaaattcattaggtagatccatgagagctcagacataaatttgagccaatggtgaagtgtgggggcaagaatgcgggttggagacaggaataaaaattgttttcttaaataaattatttaagaaaacataaataatttctagctgtgtccttttgagaaattaaatggatacagtttagctgtttaatcttagattacttttttattcattaccatactgaccttacatctctcacatgagatttgcctccctcaaccacagtccagagattggagtttctctaactaatgtccaaactgatcttcttaatggaactcagaatgagtgagtgtggcagaacttggctgctgccgatattctaaagagggagaactggtgagacagatgtccttagatttgctgcctagtcccctagtgaccattttagtttttagtatcttcaaccatttactgttaagggcaacagtgaaaaaaagcaagtcctctgtaataacaacaactaacatttattaattatttataataataacaataataactgcaaatgcatataacacttaattatgggtgccaagcactactcagtgcaagtacttttcatatataaatgtaataaatacagcaaacccatgatgcaagttctacaatggtcttcattttacatatgagaaaactgaggctcacactggtttagtcacttgcgtaggtgacacagctagtaagtaagagaaaggatttgactatggatatcctaagattgtgctcttaacaagagaaagaaagaagccattaaaaggtgatagagttaaatacttacatagattcaggtgtaaaatgtaagtgatccaagttaaggttgtccaggtcctcacttttgagagaagatatagaagacaaagtgccacgacgagaacctagacacaaaagacatcacttgggtgacggatacaaacaaaaaagccctttcccctcacttgtatttcgccctattttctctgtggaggcagggtcaagctcagtgactttctcctagataatattaagggttctaattccaaagagggatcctcttggatggatagggacttccactgagagaagaataaagctgggctgcttgcttgctggcagtgaaaacaacttcaaatcttgtatttcatcaggccagcctcttcaatgttcctaatggggtcattactctggacattggcatgggatcttatagtgtgagtttctgggaaagacggaggggtatctactgcaggattatggctaaaagaggatgcataaaaaatacatatttattctttgggagctaaacaacagtgacgaaggctagaataagggaagaagacagaaagatccttacggcgtcgtgggcttgtctggttaatatcttctgggtcatcttccaggaagaaagttgaactaaagttcttaacagatattgtctgtctgctttcctcatccagagctatagagaaaagtgggaggaaggaaagcaaaaaagaaaggaggaagggagggaggaagaaaggagggagggaggatggaaggaaggaaagattaattacacttattgaacatttatcgagcatctattttgtttagttagtgggtagatgatggagactcccattcgaccatcacgtctcctccatgatactgtttgtagtctcagcttgcttacagtgttgctgttttttcatattcatgcctgagctttctttgttttactggttactcttttttctctcacccagtacatgtggttgtgagtagaagcttgtggctgtggattggggtatcagcatgggaaactctctgctcttctacctccattctattagttcatttacttatgtggcttttgtctataattgagcctctaggactgtgccactctttcactctaatgtctcactccacacctggaacatttgggaagtctctttcctttcaccagccaaatgttgtatagctgagatgcccagtctcagcctgtgtcaaagctcataggttcaatctctacccctaccagggaggtattttcctatctcatagccacaagctacacctctaaatctaacatatgtgttgatggagcagactgagggttggttgcgacagttatggctacatccgtttaatctgatccacactgcttggaaactaattatagaaatagaggcaaattgattgtttaatccttccactgtgcagaagggagattttctttctttctaggaaacttggctgaggttgtacgtgaaggtaccaaggcagggcaaggcaccatggctaaaagtcaagggccagccaaagggacttccttgctgcatgggacttctgctcagttccaatagttcagttagaatacactcattcttataccaccttctgatctgtttctcaaagtattgtgggaaagaagtggtcagcaaaacattcaatgaagaaactgagggagttgaagagttttcattctgagttgggaagtttgcagactgtcgtgagttctgagcaatggtaattaatgctagaactgtcaggaccactctcagggcccttgtgcctgattaatcatgtgcaacacatgcagagttgaacaccattttctttctaaaatagtcataggctcagtggttggaaagaaacaggagaaggaggaaaaaagtcttatggctggtggtggaagctgatagagctttgaaccaggtcacttagcatctattaatataattgtataggatgagtgttggtttccaaaaatgagtagcaggagttgactgtctgggaggtaggaggagccaaaggggcagcttagcaggactgaggcttttcaaatcagtagtctgaatactgactttgtatacaatatgaatgcagaatctagactttttgtagcagagtcagagagcaaacccggagtcagtgaggccagtaaaccatcctctggaactttttctttcccctacctcagtcactacaaccctggccaccttaccttgttcaacttgaaatatgatgagtttcaaggatttctggagactctgggcctttgtagccagctccaacttgcacttggctatgtggtctatttgaggaatgaagggcttcctatctgccttgctgctgtctgcatattctgtagcacttttttcagcagaagtagctgctgcctcctcagccaggacatcgatcaggacactgagcctatcatacattaagtcactctatatagaaaggaaggagacagggcattgttatgagggacccatgcttgagaggacagaatgaggagtggtggtgatatggggaagggtagggaggggtaagagttgtccataaatgctgagcatagaaaaccacatgtgagaagatgaagtacttagcaaaagaagtaggtgggaagatgtgatgagataaccaaagggtgttaggagatcaaacacatatcatttgtttctgagtggccccatgcatcagtgtatatagctgagtctttcttgtgtcaaacgggcctataaaacaatgtataacatgcaaacttgaggaaagacaaatatttctggattttcatgggcacgctcctctggatatgaacgtgtccctgcttgggtgcttggtgtgtgtctttgtatgtgtacaggcttggggacctacatctgctgcatgatttaaggccttgattcttagctccatcacttaatagtttgcgatctgaggcaagtttcttaaccgctttgtgcctccatattctagggtagttgtgaggaataaatacattaatacattaaaaacagaacagtccttgacacagagtaagtgctatataaatgttggctattgttgttagagaggtaaatgtgaatgtatttgtagtgtgtattcgtatgtacatacttgtaagcatgttctggtgtacaaccatgcacatacctgcttgatgtacacttgtgtctagttgtgggcagatgcttggcatgtacatggtatgtgtgtatgcatgcagagcgccatccttcatttagcaaaagatggaagttcaatgaggttagaccttcctcatcagggaggcttaacagctgcccctcctttcctttcttttaccattcccagtgagaggcatgtttgctttttattaaaaagggcccctggctgctccacaaagagtataagacaaaaggaatgggaacttactttcaaaatcacagacactattgcagtgttgttctgttttatctgaccccaggcctttacaatatcaaccacaaaatcttccacagctgaacacaagaatctggaaagataaaatagatggcacaatgttacatgaaccatgaggcccagagcccttctctcttatgtcatcagtccccatcctcctcctctctctctttcctgatctgtcctctttctctcaccctctgctcccagcctttttctctctgctttttttttcctgtgcatatggtgaaatatgttccatccccactttagttcagtgtcacaccacttcccaagtcaagaacctaatagagcttgaccagcatttcttagtactaattctgaatttccagaaaagagaattcacttggtccaacttgggtcaggttttcacctaggttcaatcagctatgtttcaagggcccagctaatttagtacaaacaattatattgggaggactctccctgtgggaagtttttctcaaaggagagtgtagtcgactgggcaggagccccctaagaagtcccagaagaaacaaatgacccacatatttagaagggggaatgtgttcctcaggttatgagaaagcagctataggcagatattgcagagacctttcttaatgtcaaagacggaaagcaaggtgtctatactatagggagctatgctatgctcctaaatggtctataatgttgtgtttccctactataattctcttcccaaatctctggcttgcaattttgactttttggagcagcagacgacttcacctcaatgtcatctttctttcctaaactttccattcagggggtttgagttgggagaaatctgatttgggaacataaacatgtattttccttggcctcaacaccctcagctatcaaaatgagccccatgtctgacctgggaacagccccaaaggatgagagccaaaggaagactgacctggttgcgatgatcatctctgtggggtacttggccttcaggattttgttcaactcggtggctgcagattctaagtgttggatggcagcagcctaggggcaaaaggagttcttagccctggaatcttagtacaataacacagtgtgctgcccatcctcatcccctgcagcctcattgtttcttactgactctacccgcaactcaactgcctctctggaaatgataatgatcaaagaattcttgttgaaggtcaacagagatgatcttagatctatgcgtattctaaaaatttagatgtatttcattttctcttaataatcaaaacctcatatgaaggaggtactatttctttcatgtttcaaatgaacaaacaatctcatattacatagctagtaaggaataaagctggattcgaatctacatctttccaattccagaatgtaacttctttaataatattactaccaataataacagcacccacttatatagtactgactatgtgccaggctctgttctaagctacatgtatattttttcatataatcctcataacaaccctatgagataaagactgttattatctccatttcacagaagagaaagctgagcccagagaagggaaagatgataaattgtagagccaggattcaattccaggtagtctggctcttgagtctgtgctcttaattacaacttctactccttcctctctatcacccttgacattcaaacatctaccaagacttgataattctattttttgagtatgtctcaaatgtatccactgctactcatccctgctaccacttcaccagtccaaatcaccatcacctcttgcctagacaattacaacatctcctagcttttctctttgcctctagtcttttattccttcaattgtttctccacataccatggcactcctctacttaaaccccttctcttagatagcagactggatagatgactggatatgtgataaagcacgcataggaaaatgttagtagtagagctaccattttaactttcatcaatgtagaaattttcataataagataagaaaaaaatcttctgtaattcttattgctcttaggatgaaatccaaacttcctactgtggtttatcaggccctttctggcctggcccctgattacttctctagcctcatctttagtcactctccctgaatgcccccttcctggcccctacgcctcagccattatgaatgtacttcagtttcgtgaatattccatgctctcccttgcctttggaacaatacacgctgttccatctgtgtggaacagccctcccctttcttattctcctggttaattccctctggatctcaagtatcttgtgaaatggcactccttctgagcggctttccctgatttccccagactgagatagatcttcctgctatgtgttcccaaccccctctacttccttatatactaacactcatactacttgattaaaacaatttatttttccatctattcaagtagactatgtcattcttctttacccagtagcatataagaacatctcctagaataatatctcacataaagtagttactccataaatattttgaatgaataagtaaatgagtgaatgaattatatccccagtgcttaacatagttcttggtaaatagctgctgactgacatgtcaccaactctcaatgatctcatcctcatccatgcacaatgcaaaagcttctctctgggttttgccaattatttcactgagtaataaagatattggtctgaattacagctgaacagtagttacctcaaatcgtggtacatccatttcaacctgtccttttagcagcggggtttgtctgggagtctcacgaatcatcacactccatctgaaatgaatttcaaagacggatatttaagggtctgtttcatgactggtaaaaattagtgcttcaaaggtgaagacagaagtaaaaatgtttatgtggtggggggaggtgggttgtagggggtgtccaagcaatctctggtcacctgatctcaaggtgaccataagagggacctctgtctcatgacttctgtaggccagtgtgatggaaggaattgccttccctttacagggttctcagagagcagtgcttcttaaccagaggtaaccatcaagatcatctgaggtgcttttgtacaatacacattccagggccctgccaagacctactgaatctttgtggtggggttcaggttgatgtttttaaaaagctccccaggagatccttatgggcagcaataaatcaaatgctcctatatacaccagcatagaaagtctttttttcctcaggagataggatggtagtacttgctcttctctagagcagtgacaatgtaagcaagttatttctaaactctccctccatcccttttttagtttctttgaaaatctgatgaaattatagacttttccccaagagagaatatgcttaaacagatcattggctctgcaatttgaagagggttcactgaacccttgaacgttatccatggggcccctgctctagaatcgtctagtttttttggtgtttttgttgttgttgtttttgttttgttttggtttttttgagacagggtctcattctgttgcccagactggaatgcattggcatgatcatggcccactgcagccttaacttcccagtaggatcctttagttttgaagaggggcttcaatgtttgaaggatacatggtagaccctggcttcccaagagacaagccccacccaacccacaaatggctctgcactgaagccagaaaggaaatgaggctctatcaatcagagaggttaaagtattcctgattgagatgatgtgagtgatgtgggacaggaagaggcacaagggcctggtctttcagccacttacctgtctaggatcctcacactagcctgctccactctgttgaggatgtccagaggtgacttgcttttgttccagaatgcaccccagcccagaacacgagccagatcattgccggttccaagtgggatgactgccaactgacactgcaagaacaaaaggagacacccttttcagacagtctttctaccaagcttcacccatgaaggaacccagagggtactctttgggaagaattatggtcttaaaaccagtggatttacgggacttcagattctggggaaggtaatgagaggatgtttgcaattgggtgaaattttccctaaggagttggaccccagtgttaacaacacagaacctactaagtaaagggaaaagttgccggaatatgacaatattcatggccatgcttaaagaagagaaatatagctgtgaatttctatctgggctgggccaaggaggtgaagtacgtcaggagacaaagctactggagtgagaagagcaaggcggctgcctaaggacagtaaggagacatagaggaaactttctgccactcttgagactcaaggaagaaaatcagtgggttcaggaggggaaggaaattgggggttgagtgctgtctaagaccacttctgttttgtttgctctcctccccttcaattcttcactttgaagcctagggaacagagcactgctcgttctttctgtcgatgtcacacagatagacaaccagaaaacagtgtagatgagtaggcttagattgggaatctaccagtcaggctgaatatgaaacctgggggaaacatattttacagacagggagggcgaagacttgggacttcttgggatgggcagctgcacacccctactctttctagcaatggctaaactgagtcatccagggacttaccttttcatgtaatccaaaggcatcaatcagagataagacccagctcacgctgccatctccaccacaaaccagaatgcgaaagcgagcaaagttcttgaacatagacagcctggaaggacaaagaggaaagggggtcatttcatgaacagctgggttttgtaacttttcctacaatgtgtcaggacacaaggattgctgctttggcactctgctaacagaccacctgccttctttcccttagcccttatctgtctgtgggatctaagaccatagaccatcccagagatcaggctttgcctcaactcattttctttctgtgcctctggaaaacactagtaacctaaacagacccatttgctgaggcccaggaagatgccttgcatggtggccagtgggctcacaggaaccaggactgagcagccagatggtcccaaaataaaacaggtctatagaggagatatatctatttggtcccgggaaagagagtggcaggaaaagtagacagcagtatccatttgtctctttctctcaggttaggaggcatagttttacgttttccaaccaaaaaagataaagcaaatctgacaggggcttggacatgggcttgaagggatttctgggagagggctaagagccctcctaccagccaacccaaaaggctctggagttatgtgcttgtgtcctgacttgagaaaatagacctttcctgcccaaatacaagaactgattccaagaagcctgttttagtttagaatgtatagaaggaagactcccttacatacccaatcatatccatgggatacaggcttaccctgcttcaggtccacccttcaataagtcgaacacttgagatgggttaaggtattgcttgaattttcggaggaagacgatcccctgatgatcgccacttttggagttgatgaagatgagcaagggacatgaacaggctgatgaccaatcaagattccagaagtctgaagatactactaattggcctgacacaacgaaaagaaaaagaagaaaaaaaagaacggacccgttgagatggaaacgagacatgacttaacatcacattttgcaataactttttgagtatgagtctcagtcttttgaaaatgaggagcagaggaaaagtcaagataccacccagaggggcttaaaagtatttgttgtatttgtctagctgttgtcagacaaatgacatttgctgagccactaccacatgccaagcatcatgccagatactgctaggggtatagtccctgccttcaagctcaggagagagactcatacacaacagtatgttggaacataaggaataaagaaattggtgccacaacaaaggattagtaaaactgtgaggaaactgaggaaggagaggattgagaacccaggaggaagaccagcacacaactagtcctttctctgcccaggatacctcagttcttatagtgagaagataccaggtcaggagagaggggaaggaaaggctgtcatttagccaggagctaataacagaacgtatcaatgtggggtgaagcaaagagctttaatcacttctctaaggctgttgcagagcaatctgtgttatctcaccaacttccctggggaaacaagactataggaaaattatctgaacaagggagaggcttttaataatctccaatattgtagttacccatagagaagtagggttatagcagtctaaataaccaaagcctgccagctcgtgctgagtctcagagcctgttggcagggagacaggcagtgtgcaatggcctcctaagagatgctagacaaatagtgagcccccagacctcggagctgtggcttgacagggatgcctctgcaaaaataaatacacagggcaaaaagcatgtggctcactcctcagtgggggtgggaggaggtgggttgagaagacccatttgttttagcctgggtgaaagggagcctgaaggaaatctacttgagcagatttcataactggtttgcctggaaaaatcaaaggcaggtttcccctatgggccaattcccactcactggccagtggagcttgaaggcatcctaagccagctagccagtcatgcaccaaatttttaggacttgccaggactcacagctacaaggggagtcttgtagaagctgggtcccctcactagcatagctcggaagtagttactttccccgaatacattatccaaaagtagtaccccttccaacatttttttactaaagtaatatgttgacacaatggtagttaagacacattaatcccttcattcaataaatatgtatggagggcattctctgtgcctgctttatgtcctgagaatacagtggtggacaagatagaaatagtctctgcccttgtggaacttatattttaatggaggagacagaccataacaaagaattataaaaaagaatttgccatgaagaaaaataaggtagggaaagggggtagatattggaaggggtgttattttagacagagtgtcagggatggcttctttcaggaggtgacatttgagatgaaacttgaatgaatgcaggagtgagcaatgcagggaagagtgttttgggggtaggaagaagaataagtgccaggaccctgaaaagggagactgtctgggctgtctgaggaccagtgaagagaatagtatggttattgtggagtgagtggggggggagtggcagaagatgaggtcagagaggtgacatgggacagatccaatggcaacaagatgttggaggaagcagtgcaaaaataaggggaagactgttcagcatggacttgagacgtcacgagtcaggtcttaagatatttaaagaaagtagtcaaaaggtgttaactttttatgtgcttgctcccctaccaatgaacaatgcaggccccaattcatggcctagccccaagcttacctctcccttgttttagaacctgtctgtgctctgtgcttccctttctcactctgcaaccctctgtcaacaccctctaagtgagcatatgactttgggtatgcaccctaattaaaggactcatggaagcaacttcttgccaacatctagtggctctctgaggtgtgcttggaagcaagcactttccctgccagaggtcctggaataaacctatctatgcccccaaagtttttgttttgtttagtgtcaaaggccctttgggggtagttcctctctaaaggtgagacagcagtggcagtgagaccaaccactgtgtactatttgggcctcagtttccttatcttcaaaatgaatcattcaaaaacttaaattagtttcccagtgtttagatgaaaatggacctttaaaagccaatcattatgctcataatttggctcctaaagatgagaagatggtcaaacttactcataacaagaaatatacagattaaaactagcctatgttaacatttttttttcttgtctagaacattggcaaaaaaaaaaaaaaatagataacacacttgactggggaggccatggggaaataggcactctcatacaccaagaatggacgtgctgagtgacacaagccctgtagaggtgaatttgacagtatctatgaaaattacagaggcatatgcattttgacctagtaattccatttcttggaatttttcatatagacgtgtatgtaaaaggatatgcatgaggctgttcactgtggcattatttgcaatagcaaaagactgaaaactactaaattattcatcatagtggactggttaagtacgttatggtgtatccatacagcagaatatcttgtaactgtaaaaaagagcgaggaagcaatttgttgataaggaaaagtctccaaaatatactgtgaaggagaaaaagagcaaggcgcagaacaatgtgcatagtattaaaaggggtggataagaatatctatttatatttactggtatatacatgaagaactactggaaggtatttaagaaactaatggcagtattgaactgtgagtgaggatatgggggctgtaggagattgagaagatcagagaaaagatagcagcaagacttttcattaagtattatgtgtatatatgtatttcttttttaaaaaactgaaccatgtgaatatattaactagacaagaattgaattaagaaataggaaaaaagaattatgctaatgctgtctataaattaaatagccatgagggtgtaaactagagtgagcataggaagcttagggagaaaattctgtaattaaggcaacttgaactttaacatcaaacctcatctgtggatgggaagacagtgggacatagccccagcaggaaggcagtcccaggagactacaggggcagctccatctagtatttccccctgaggaagagaatatctgaatttcagcaaggccaagtttgtcaagagaatcttgtgaaccaggtgacaaagatgggtgccactgagggcagaaatgtaataatgttaagatttataaccaggcaatcctttccacaagattgcttttgaatagactgatgttaatcataagggagtgcccagtattattccacaattttaattgacaattcacatggaaacatagaagtctggcttgtgaactctgaagtactcaaagctggaggaagagatacttaatgacagaatcaagattgaaaagtgaccttgacaggctgactggtcaaagtccagggatgaaatgtaaagggaataaatgtgaagcttgccctttaggctcaaggacataaattgtaccagaacaggacaatacgaacttgacttggcagcatcaagtgtgaaaagagcttaggggacttagttgactttaagctcctgatgagtcaacagcctgaaagaacctttcaaaaaaagctcatgtttctttgagctgcattaatataaccatagtgccctaaacagggagccaacagtcccactcaaattcattctgttcactccaaagaaagatgcgaaattggcataggttggcttaccattctcttcccgtacttttaaaatcctcccttacaaatgtcaactcatttaaccttcatgacacacctgagtacaattgttattccttattggcagaaaacaaatgccagattaaccacagagaggttaagtaacttgtccaggggcatacagtaaatgatagagtgtgtttctaggactagtagtatcagcaacatctgggacttgttagagatgcaatttcctgggccccacccagatctactgaatcaaatgctctgggggtagtgcccagaaatctgtgttttaacaagcctttcagatgcttctgatacaacaaccactgcacttcactattttttctccatatgagccagtgatgctatcttagtcgttgctcagcattgagccttacatacaggcagtattcagtaaatgtattaaggaattcatgtaacaaatcttgactgtgtgtataccgtatacccaggtctgagtcaagtgctaaggatacagagagctcacagtctggggtggaagatggacaccattataatgtcatgtgttaggtgctttgagatatgtcttcttggtttatagccatagaagtaattgatttgtttgggagagtgggaagaggccattacagaagctgtcaaacagagaagacaatgtttaattttgagctggaccctaaaggataagagaaggaatataccaagcagactggataggaaaaagggataattggaaggaattctcagaaattagagtctactgactgaataaatatatacgtgaacagatgggtgtgactcaacgctagcaagggccttctcagaaagtcatgagctggatgccctcatgacttcagctgggtgctgaagaaaggattctctagctcagccagggggcattgaaccagaccatctttaaggacctcacatggctaagattctatgactggaagatgcaaaagattcctctgggatgggaccttccagtaggaaacttacccattaaagggcataaagccacagccaagaagccaggaagacagagtcaagaagatagggaagtttgaaagacatttctaagaagttctaggacaagtaatgcatgatagaaagaagggctggcagtgagtgagattcaattggatcaagattgcagatgactaggaggaaaagttaaaagctaactcatgggatattaaataagacaccaaacaaaaagaatagattagcccaggtgctcctaagcaataatattatatcactggtggaaagaagaagaaagtaacaatgccattatttgacaagctataacaagcataagaagtgatataggataggaagaaataaattttaaaaacaccaacacaaggacaggaagcacagaacatgtttggcccagttacaaaggagaggcggcaaccctcttaacacctatttggggtcatttgtggcatgctgaggtgggccatctgcttaaagacatctttgtcaggtccctgtgggggtgagcaaaatgtctcagattcaaaactaggttgatttcactaccagcctgattttgctcagctgaccagtttgctacttttcttcttgtatcaactgcatcttcccctagtccctcattctcctaactaggcaagtatctcttatttactaagtcatcaatttcatcacctctttggtcaactacctggtgggtgactccatatggataactatttgagtagatctgagaataatatatgcatgtatacctgagtgaaattcagttttgtgtctttacatgttattatggggacatatgagtatacttgcctgcagaaacctgtatgaatggctcattccatgtactaaggtctagctatatctgtgttagggttggaaaaataaccggaaggatctagagtggctgtgtgtgtgtgtgtgtgtgtgtacgcgtgcacatatatatgagcacgcacatacacatgtggtatgtctagttctaaaactatgttgtaacggctacaggaatctttgcccccttctgttctctaaggaaaccatctactcttctttcttttcctttctttgcttccagctaatgctggctcttccctggcagtgaagtgagcaactagcatctatgtggggataatttttaagtcagtgaaacgagggctcactaatcactcttggaccagtggatatcccacacgtcagagatggacaaattagcaaattagagaaatatagattaaaacattccaggaagaatttgaactttcctccagtaagtgaaattgaccatatatagagtgaaactaatcatacacaaactgaaatttatgagcagtgtatctcttccctggcttagtgaaatagtagtatgtcagtggtaagtatattagatttctaaatctcttagtattagtaaaataggttaggtcttttaagctgtgatatatgattttgatcttgacagttcccactctttaataatgagtaatgggagaagtaaatgaacaagtcaatggcaaaaaggagagtctctcagaaaaaacaaagaaaaagtagggaaggagaggtgaattcaaaaggcaggtgccaaagagtgaatcatccctgtggggtctgcactttttattaggctaggagactagatatttagttgcccaagaagttgagggatttaattttatggtcctttgaggttatgtttttagatacttaggcccttcacatattatcatctatcttcacaatagatagcttcattcccgtttacagatggggaaagcaaagctcagagaatgtaagtgactaacccaacatcacatatctagtaagtaactaaagctcataattgcctagctcttgttttttttccttacgtcatgatacctccatgtcttacttattcttaaacaaacacaaaaactatacaaaatacccttcttcttggcttctgctttttttgttctaacattgctagacctcttgatagaagactctatacaaagtttattcttgctgcattgatttcattactacctcctttccgctcaacctcctataaatggttaatatttctaaggttttctcatttccaaatgtctctaccattcccttggcacttagcatatgacacatcaaattgttaattgttgtattatatcagtagcctgaatccacaataatcaatagctctggcaatgcccatgtcttagatctttctgtagccttcagacaccttgagaacagagttcttaataaatcactagagtccaggaattgacaaagcatcagtgaagttggggtaatgatcatgttagtttcatatttaggaacaacattggtgtttgtttccattttaaaagtaagataacctggccttcatgaagttcttccttgaccacctggacacaaacttatttaatgacttatccagtgtttggaaatcatgaaaaagctgaaatcaattctgatcagaaacaattgtgaccgagctacagagaacatgcccacatacatatacaccagaaagaacaacattcacaatcccaaaggtaagagaaccaggagctatctatatacacatgcacagtcctacttccccaaaatgtttgactggttgaggagaataatttaattgcagtgcttcttcccagcctttgcaccttccctacatgcccaatgtgcttctgaggttaagatttaactactcaccatcgcctttggggtcgcttagagcagtgggaggaatgactgatgagcgatggcttctgaagcaacattccttggaaaaccgtctcctacagtcatcatgcacctgaaacgacaagagaagagcagagaaaaaaaaggagggggagagaaaaggatatcattgatcagtcttgagttccaataccaagatttagattcttagtatttaatctccctttctgagatttggtgccatacatatatccctaactcacctgaacacccccattctactctgagcctacactgtctctcagtgtggcctcagaactctggtcctttcaaaggtagctttcagaagatacccacctacaggcactgagaaatcaccagttctaaggcacaaccttagtggcctgcagaatggggaacttacatgcagtataaaagagttaataataataatctaatattacacttcaatccttataacaacaggtgtgtgaggtagaaaaaacactattgaattcattttaaaaatgaagatgccaaagctcagagaggtaaagggttttgcccaaggtcaaacagctgggaagtgacagctgagactctgctgcctttcccacaagcggccattctttccagatttctgacatcttcaagtgccacttcctggaaaattacacattttctagggggaatgaacctggcctggttattcaaaagcaattgaaaaaaaaaaacagaggacaaccagagtcttctaagaagaagcccatacttcagtttcttcttgtctagaaaactcagttttggagaagcatctaaaaggctagaaatctagatcagggtctctcaacttcagcattactgatattttgagccagatagttctttgttatgagaggctgacctgtgcattgtaggaggttcagcagaataccaggcctctacccactccatgtcagtagcgcttccctccaccctgagttgcaaaaataaaaaatgtctccacacactgacaaatgtctcctggggggctaaattacccccagttgaggaccactggtttagaggcatggtagtgttgtagttaagagtgtggtcggctgggaacggtggcttatgctcataagtccagcactttgggaggccaaggtaggaggatcacttgagcccaggagtttgagaccagcctgggcaacatagcaagactccgtctctacaaaaaaattaaaaaattagctgggcatggtggcatgtgcctgtagtcccggctactctgaggaggctgaggtgagaggagcccacctcacacgagcccaggagtttgaggctgcagtgagctgtgattgtgccactgtactccagcctgggcggcatagtgagaccctgtctcaaaaacaaaaaacaaaacaaaacaaaaaagagcatagtctttgcagaattatgtatgaatcaagactcttgcttactggctgaatgaccttggacaaatgaaattggtccaaatgaccttggaccccttcacttttctgaccctcaccttcctcatctgtaaaatgggaacaatgaggcccggtttaggcttattggaaggaataaatgagatcatgtatattaagcactcagtatatagtggcaataataatgtgttaatattatcaaccatttttaattaataaaggttacaagttcctaggaaatagtgaatgagaaagggagtaggtttctcaaaggcagactcagaacttatttttaattgcccatactgccattagagagctcagcttttcccatttgttagtaggcctcaccaattaagaagcaacaaagatggtcttaaatctttctcccaaagaaaggctccatagtcagatctggaaaggcaggatactaagatttatactatggaatctgtttaacctgttttgagataagagtttcttagatttctatctatgtgtatacatggtcaagctctaagccactccctcgccaggagttaagttctctaaatatcaagatgagaagagtcttaccgtagaattacaccacaggcagcggaagtcttgaagtctttgataactgccacagctctcatgacacactgcacactgagagctgacaggcatgtttccttctacccattgatggggcatgttctgcagaagggtaaaaagacacaggaggtagaagttagagacataaggagaggaagggccaactggaataattgtactactccatggaggacattaggtaaatgacccaaatgaccctgccctccctactccaatgcaagtgaacaatgacaagtggaggagggaggttcattcttccagataagttggattgtgagcctaggactttgcttatctggagttaggaagaagtcttcctccccctgtgtatcctggttgaaggggacatgggagaggccgactgtgggaagacatggctagtacttactacttcatctgcaggcagaaggaggtcatcagtgatagacaatgtattccacttgcagtctttgcttgctctcaaagcacacaatctgtgagatttcactttgcacactgtgagaagaggaagagaaaagatgggtgtgaatctggtgacagtgaggattctaattctcttcccaaagctgctctgaaagttagaacacagatgcattctaaatagttctaatgcacctccaaaaacctatttccaataggatccagttcctttttattcttactggctaatctttttattatccaacttgaatgaaaattgatggtaagaatgaggtgatttctgtctttttaacacttgtgataatatagtcccatccccccacactcatccttctattttcatcccctttatgttagtttcctccctttttctttcctcaatcagggttaacctcacaccagagtcagtgacctagtatgagttaatgatactaaagccacatgagttccttcatccctatatctacccactgagcttcacttcctaaaggaatcagaaaggtaccttcacagatgatggcatctctagataaggcaggaatgctctctcgacaaacattgcagtgctgggtccggtggctgtaactggagtaccaacaatgcattccaacaagaaaagggttgttttctgctgcaggtatctaaaataaataaacgagaagagagaatggaggatgaatcacagagacggattaaagagggcctgaaaatctgctgctaagtctaaaatggcctgctgtataggtgtcagagcgtgtgaaggggaagactgaaagttggagccaatacctgggacctgggatactttgtgtgcgtttttgtttgttttgccagtcgtttcaaaaagaaaaataatagaggggcagaccctggaatagaagctgaaggcaggagtaattatctttttttttttttttttttgagaggaagtcttgatctgtcaccaggctggagtgcagtgtcgcaatctcggctcactgcaacctccgcctcccggattcaagtgattctcctgcctcagcctcccaagtagctgggactacaggcatgcaccaccacgcccggctaatttttgtatttttagtagagacggggtcaagtgatctgcctgcctcggcctcctgaagtgctgggattacaagcgtgagccactgtgcccggccaggagtaatgatctttatactgcttggccaatcactctattgtcttagttcaagcaaaaatgtgttgtcttagccttggccttggttctctagccagggaataaagacaggaggtaaggctctgactctgggctagggaatattataataaggctttaactacctcctggaggtatacactttccttcctggctgccaggtgagcagagcattgctttacctggacgacagtttcatctcaggggattcttttaggaatcccttgagtattcttttaggaataccacgctctgactgcctacagcagtttcctgattaatcagcttaattcatccaataatccattaaacaaatatttactgagtaaatactttgtgcttggcacttttcaaagcatttgagatatagtgaacaagacacaacccctgcctacatggagtggcattctttttggtgtcctctttcatggtactgagtttgacattttttgttaatgtgccttaacattttttgttaaatgctgcatttgtatttcacagcctgactttcatgactgtagggaaagcaagggtataccagcaacagttttgagattgaaagaagggaagggtgagcaccaaaaaaactccaaggactcttacaccttttcactaattcctgagaatgtctgattttctccttctctgccttcccctgaagttcagacataggcgtacacagagcttttcattcttgacattataatgagttgggtgtgtaaaggcatgacaagactttaaaaagaactatattttctttctgacatcagttgacagtggggggagagagagagagagagagagagagagagagctagctactgagggctctagcacattaagtattcatccttgatcaatttacatgaattagatatccaagacatagcctgcacattgccctctctgaccactccttcccacttctggcatgctggttacgtgctaagctactgttgatttaacctggaaccttctggaagggaaagctattttgatgaactaaaggctcacatgttctgggattgctttgtgattgtaatgtttattgtacattaagacactggaaagctctagggtgattagaatagaagatggagagtcctgagggagtgacatactcttggctttggcactttgagctcctagaacctttctactccccaagtcactagattgtaattctacaagcatcttttttttccctcccagtctcctctcctccaataattactaagaacctattatgtatcatctaccatggtaggcactggagatgcagagatgaataaaccatagttgtttccctcaaggaatttatagtctactggaggaaacaaattctaaaacagatcattcctgtatagagtgacaagtgaagctcttctagaatgtgcaaggtttcacaggactgcgtggaagaaattcagagctctgcctgggtataatattaaatttcatcatctaaattgcctacagaatacaaaggaataggtaaaatggacattacttaggttcagcagttgaggtgatggaatttatattccttgtgtacatcctattctgtaagaaaaagttgatgcttcccaccctggatgagtatgtgtggcgattgaactgtgtcccctcagaaatatgttcaagtcctaacccttggtacctatgaatgtgaccttacttggaaataggggtttaaccgatataatcaaattaagatgaggccataatggattagaacgggccctaatccaatgactggtatccttataagaagagaggaatttggacacagacaggcacacacaaagaggagaacaccttgtaaagatacagagcacacagacacaggggagaacaccaggtgacaatgaaggtggagattggaatgatgcatctgcaagccaaaaaatgccaaagtttgcctgcaatcaccagaagctaggaggaggcaaagaaagatccttccctagggtcatcagagaaagcatggctctgcagataccttaatttgggacttctagactctaaaactgtgagacagcaagttgctgttggttttaagccatccagtttgtagttattttattatggcagccctaggaaactaatacagattttggtactgggaaatggggtgctgctgtaacaaatacctaaaaatgtggaagtggctttggaactgggtaatgggtagactagaagaattttgagacacatgctagaaaaagcctagattgccttgaactgagtgtttctaaaaatatgaacattaaaggtgtttctgatgaggcctcatgtgaatatgtggaacatattggaaactaaaggaaaggtaatacttttataaggtagcagagaacatggctgattttgctctactgttgggtggaaagtagactttgtgagcaataaacttgaatatttgactgaggagatttccaagcaaagtataagaggtgcatcttggtttctctttgctgtttatagtaatatgtgatagggaagtgatacactgaggaaagaaattgtgttagtctgctcaggcatcataaaaaatagcatagactgagtggtttaaaaacagaaatctaattttctcacagtttacagctggaaagtccaagatcaaggtatcaatcaattcagtccttggtgagggcttccttcctagcttgtagaaggccaccttctcactgtgtactcttgtggtttttcctcaacgtgtgcatgcagagagagagagagagaagaaagaaagagagagagagagagaacacctctttcttttcctcttattataaggccactaatcctatcagattaggtccccaccctatggccacatttaaccttatttgcctcctaaatgtcctatctccaaagtcacattaggggttagggcatccacatattaatttgggtggagggcacacaatgcagtccataacagaactattaagcaaaaagtcaccagaactagaagatttagaaaattctcagcctatccatattgcaaaacccaagaaagtgtgccctgcagagaacatcaagggtgtgtctggacaaacttttgctggagagattagatgtgggacacctggctccgattaaccacttcagcagaacactgtcagattggactgaacttggacttaagggtacagatatgggataaaatgaaggaaggttgtcagacttctgagattctataggcatgaaacacactgataaagcgactcagctgtgaacatgtgttatccttcaagaaaatggaagaatgacttccaggggtagctcagaggccagcaaggctgccgagagaggctcagaggccagagatgctgctgttgccatcataggcccaaagaatgtgggcccaaggggcagaggcactgcctccttggttccagagggtggagttgtctcctgggttccagaaggtggggctgtctccttggttgtgcaggggcttgtggggggattgactctccagtgagctaagagagtagggttagagaacagaacacctagccccagagaattattctcaggcctggagaacctgatggaatttgccctgctgggttgccaatttttttttaaacccacaaccattttattccttccattttatccctttctttctttttttgagacggagtctcgcaccgtggcccaggctggagtgcagtggcgcgatctcggctcactgcaagctccgcctcccgggttcacgccattctcctgcctcagcctccctagtagctgggactacaggcgcccgccaccacgcccggctaatttttttttttgtatttttagtagagacggggtttcaccgtgttagccaggatggtctcgatctcctgacctcgtgatccgcccgcctcggcctcccaaagtgctgggattacaggcatgagccaccgcgcccggccattttatccctttcaaaatgggaatatctgtcctatgcctgtctcaacattgtattttggaagcatatagcttgttttcttggtttcacacgtccatagatggagaggaatattgctgaggatggaccatacacagagtctcattcatacctgatttagattatttacaaaatgatattttggacttagatttaacgctggaatgtgctatggcttttgaagaggttgagatgacagtgaatgtattttgcacattggaaggacatgaatttgggggggactagagggtggactcttgtggattgaattgtatccccctaaaggatatgttcaagtcctaacgtccactacctgtgactgtgattctatatggaagtagggtctttgaagacatattacatttaagatgagatcatactatattatggtgggcctcaatccaatgactgctatctttataaaaagagaaatttgaacataggtacatacagagaggagaacaccatgtgaagatacagagggaacagacacaggggagaatactatgtgatgatgaaggcagagattggagtgatgtgtcagcaaactaaggaacacgaagaattaccagcaaccaccagaagctaggaagaagccaaaaaaaaaaaaaaatcctcccctaaatcttacagagagatcatggccctgttgacatgttgatttcagacttctagcctccaggactctgagaaaataaatttctgttgctttcagccacaaaatttgcagtaatttgttacagcagccttaggaaactagtacagtatatcattacaggtcttcttacttgttgacacagattaaaaatccattctgaagacagatttaaaactgtggcatgtacacaaaccacggatctctaaatgctaaagaaagtagttttctttaaagctttcagtgtgtggttgttgggtttttgtgtttgatttttactctctgtaaaatacttaggtgaatacattcatgcagtccattgctccgatcggattcttcatttgcaatggactgaatgcttgtgtacccccttcatatcatatgttgaaatcctaaccctctaggtgatggtattaggagatggggcctttgggaggtgattaggtcatgagattggaatcctcatgaatcgaattagtgcccttataaaagagaccccagagacccatctcagtcccttttccaccatatgaagacacaagaagacaattgtctatgaaccaggaagtgggtcttcaccagacactgagtctgccagtggcttgatcttggactctctggcttccggaagtgtgagaaataatgtttgccgttttaagccacctagtctgtggaattttttatagcagcccaaactgactaagacaggaattggtactgagaagtgaggagtactgctataacaaatacttaaaaatgtagaaaaaactttgaaactgggtaatgggtagagattagaagagttttgaggtacatgccaagaaagcctagattgttctgaatagaattttaaaggagattttggtgagagctcagaaagggaaaaggagagctgtagagaaagcttctatcttcttagagtatacctgagcaatcatgaacagaattttggtagaaatgtggaccggccaagaacatgttactggacaataaagaaaaagtgattgttgttataaagtggcaaagaacttgcctgaattgtgtttgtattctagtgtttgatggaaagtagaacttgtgaatgatgaaattcgatatttagctgaggatatttggttcctcctgactgcttatagtaaaatgtaagatagagagtgacatcaacaagatggtggaataggagttctccagcttcactccctgcactacagaaatccaactggcaactatccacaggcaagaataccattatgaatatcccagaactttggagtgaggctgagacaacccccttggaccacagaactgagaaaacccagggtcaaatggtaagagtaatggttctctttgactatgccgcttccccctcaagctggtgcagtgcctcagagaatttccctggagttatggtttctaagtgggaaaagagagttgaaggcagatattcaacttcctcacatttcgggacccttcaaaggaagtccactcctgtcttgtcccacgggaaacattggtagtaccagcagggctaggtcacttggggtcagtaagaaacaaaaaatggggtggggctcacagtaatcaatgtatagatcttggtggctgctctgtgttcctgccaatggaagtgccacatcagaggagcttgccaatagcaccatgctgcaggaaacatggtccacgggtcttccaggcttgaatccctagctagcttcttcagacaacctgggtgctctgattaactcttccccaggccaagggataactgttaggccagcgattacccatggaggaacagctggccccatccaaccctagtgtcagagaggtgatccaataaattctgatgctcattgacaacaaagccagacaaggacacaacaaaaaaagaaaactacaggctaatatccctgacaaacacagatgcaaaaatcctcaataaaatattagcaaactgaatttaagaatacataaaaagaatcatttaccatgatcaagtgggatttatccctgagataaaaagatgatgcaacatacataaatcaataagtgtgattcaccatatcaacaaacgaagaattcaaatcacatgataatctcagtgatgcagaaaaagcatttgacaaaattcaagaccctttcatgatttaaaaaagaaaaaaacctctcaacagattaggtatagagggaatgtaaccagcataataaaggccacataacaaactgatagctagtatcattctaaatagtaaaatgttgaaagcttttcctctaaaatcagggacaaggatgcccactctcatcacttcttttcaaattctgataattgtcatatgtaaaaaccagagcaattaggcaggagaaataaataaaagatatcctaatagaaaagaaacaagtgaaattgcctctagttgctgatgacatgaccttatatatttaaaaaaacctaaagactctaccaaaaaactgttagaactgataaacaaattcagtaaagttgcaggatataaaatcaacatacaaaaatcagtagcattttatatacaggttgagtatctcttatccaaaatgcctgggaccaaaaagtgtttcagatttcagattttttaggattttgaggtatttgcattatgctttcttgttgagcatcccaaatccaaaaatctgacatctgaaatgccccaatgagcatttcttttaagcatcatcttggtgctaaaaaagttttggattttggagcaattcgggtttgggattttgaaatttgcgatgctcaacttgtaccaataatgaactatgtgaaaaggaaattaagaaaacaatcccacttacaatagcaacaaaaaagaaaatacttaggcgtaaatttaaccaaggaagtaaaagacctgcatactgaaaactatagaagatcaattaaaaaatggaagaaaacacaaataaatggaaagatatgctgtgttcatggattggaagaattaattttgtaaaaaatattcataccacccaaagcaatctacagattcaatgcaatccctatcaaaattccaatgtcattttttgaacacctttcctctaagatcatccagtgtcatttttcacacaaatggaaaaaaatccttaaatttgtgtggaaccacaaaagaccctgaatagctaaaacaatcttcaccaaaagaacaaagctggaagcatcacacttgctgatttcaaaacataggtaaagtgattataattaaaacagcatggtactggcataaaaacagacacactgacaaatgaaacagggtaggaaacccagaaataaacccatgcatttacagttaactgacaaaagttgactgacagcttttgacaaagtttccaaaaacacaaaatagagaaaggacagtcttttcaataaatgatgttggctggatatccacatacaggagaacaaaattagacccttatatgaggggtcctgaacctctgagccatagattggtaccagtccatggcctattaggaaccaggccgcacaataggaagtgaccagtggacaagtgagcattactgcctgagctctacctcctgtcagatgagcagtggcattagattctcataggagtgagaatcctattgtgaactgcacacatgagggctctaggttgcacactccttatgagaatctaactaatgcctgatgatctgaggtggaacagtttcatcccgaagcccccctaccaacccccaaccacagtccatggaaaaattgtcttccatggaaactaatccctggtgccaaaaagtttgaagactgctgccttataccgtattaaaaaatcaattcaaagtgggttaaagacttaactgtaaaagctgaaactctagaactactgtgataacacaagggaaaaagctccccaacattggtctgggcaaggatgttttggctctgacccccaaagcacaggcaacaaatgcaaaactggacaaatgagattacatcaaactaaaaatcttctatacagcaaaggaaataattaacaaagtgaaaagacaacccacagagtggaagaaaatatttgcaaaccatacatctgataagaggataatatccaaaatatataaggaactgtaacaactcaatagcaagaaaacagcccaattaaaaatggcaagagacctgaacagatatttctcaaaagaagatatacaaatggccaatatgtacatgaaaaaatgctcaatatcattaatcattaaggaagtgcaaattaaaaccacattgagataccacaccacacctgttagaatggctttttaacaaaaaagatgaaagataataagtgttggagaggatgtggagaatagggaactcttaggcactgttggtaggaatgtaaattaatatagccattatggaaaatggtataggggttcctcaaaaaacctaaaaatagaacaaccatatgattcagtagttccatttctaggtatatgtgaaaagaaactgaaatcattctgtcaaagggatatttgcactcccaagttcatcgcagcattattcacaatagtcaagctatggaaacagcttaagtgtccatcaacaaatgaatgattaaataaaatgtggtatatatacacaatggaatgctattcagcattaaagaagcggggaattctatcactggtgacaacatgggtgaatctggaggacattatgctaagtgaaataagctagcacagaaaaacaaatactgcatgatctcatttatatatggaatctgataaagttgaactcaaagaagtagagaatagaatggtggttgagggagaggaggagggaatggggatatcaaagggtacaaagtttcagatagacaagaggaatgaattttgagatctattgtgcagcagggtaactatagtcaataacaatgaattatatagagtatttttaaataattaagagagtaaatttcaaatatctcaccataaaaaatgataggtaatcggggtgatggatatgttaattagcttgatttaatcatgccacctcgtatacatatgtgaaaacatcacattttactccataaatctgtgtaattatgatttgtcaatcaaaattaataatttaaaaaatgaaacataaataaatagctcattaatcagttttattttgattatagttaaaattataatattgtacatatatttggttaataaaatgttattaaaatgaaaaaatgtgagaggagataaatgaattgaggatgaaattgttaagcaaaaatcccatagaatttagagattttggaaaattctcagtctgtccacattacaaaaaataagaaaatatgtttgaaaaggtgtgaaagacccactatttgataaggagattagtgtggatgtcaatcacagacttaattagctatctctacaaaagccagcaatagagatgggattatagtagcagaaccactgtcagctgagactaaaggaaattgagaaaatgggatgaaacaaagaagaccctacaggactggaccatagaactattcggatgtgaagttcttcaagacaagtaaagaatgatcccaaaggtgattcagagatcaatagagctgccatcccaccacaggcccaaagtgcacagttctaggtgacaaggctgtctccacgtcaatttcaaagggtggaaaccaatgcccagcagagctgtggggatggaagagtccagcagagccctggggacttgcttctgttctaacagagaatcatgccatgaatagggccactgtagagagccacagcattggcactgccctgctgatctgtgggggtgatgttgccactcgtgtaggtctggaaggcagagcattgagccagaggattacagatgctcccagtttactatggggttacatcctgataaacccagtaagttcgaaatattgttaagtaaaaaatggacgttttgtagacatgatgggatgtaaaaacacaaagtacaatatctcccaaaactttggcaacacagtgcactgtagaatatgggttgtttaccctcaagattgagtggctcactgggaactgtggcttgctgctgctgcccagcacggtactgcctatgactacctcaggaaaagatcaaaattcaaaattttgaagtactgtttctactaaatgtgtattgcttttgcaccattgtaaagtcaaaaagctgtgagtccaccatcgtaagttggagaccatctgtattctccaaacttaagatctcatggagcttgccttgccaggttttcgacttgcctgggacctgtcatttcttccttgttttctatttctcccttttagaatgagaatgtctatcccatgcctagttcaccatttctattttggaaggacataacttgtttgacttcataggttcacagctggaaataaattttgtccaaggctgtctcacccatatctgatgtaaatgatatttagatgatactttagactttataattcatgttggaatgagttaagacttttggaatttttaggtgaaatgaatgtattttacatgtgagaaggccattaatttggaggtgtgcaggggcagatggcaatgcactgaatgcatgctccccacacgttataggaagtgatggatccctcatgaatgagattagcactcttataaaagggaccccagagagttttcttgctcctttttctgccatatgaggatacaatcagaagactcccatctatgaaccaagaagcagcccctcaccagacactgaacctgccagtaccttgatcttggactctacagcctccagaagtgtcagaaaaacatgtttgttgcttaagccacctagtctatggtatttttattatggcagcctgaactaagacatcactgatgtagggcagctaagggtactttctccacctcctgaattcctttcagcataatcgagaagtcatatatgtgtattaattatttgtctagtagttaaatgaaagcttattgactccaaagcactttccaaatgtgaggatttagtaatattaagtgtttgcaaagtacataaaagtatcaggtgaaatatcccacaaagcacaaagttggctacagatataattccataaaggagcctttttggggatggcttacatgataaaatgttgagtttagataaaacgaagtcagtggtttgtgctttaatgtgaactaaactgctcagttctatcaaggtttggggaattacagaagagtgttagggcctcccaggttggccattggtaggatgaccatgttgtccaaattgggccactttctacagtgaaaggggagctgttaatacttatgccgggacaagtgtaaactgggctcagcctgagcaaaccactagccatggacacactatgcatgagttagagtcattttgccactttgaatttatttgttgatctatacgattcagttgtctaccttagtattcctgccccataatcacaaagggtggaaattaaaggacagaaagaagataattaggaggaatttacgatatcctcctgagaacttagattaaaaatgaaaagaactaagatattaattttgccagaatcaacttatgattttaggtaaggcaactgaacctctctgaggctcagttttctcatctgctaagtgaaatcttggaatcataagcttttcaagttgaaaggaattttgaagttcatctagtttgcccacttgaaaaaaatcaattttctgtacaacatctgacaagcagttgttcaatttgtttgtttgtattacttccaatgatagggagttgtccacctcaagagccagctgatgtcattcctgcaggttacagtgaatgttggaaagttatttcaactagaccaaagtttcagaaaaaaatttccaagatttagagctttaggaacattagatggacttttttgcaagaaacttagttctctacctttggaagagttcaaataaaggccacatgacttacatctccagatgctctaaaatctagtatctggagtccagataacttttaaggtctatttctgtttccacggtcaatgattccatggcaattcattaggaagagctaactttttaatctagtcttccaaggagctccttatttctaactttctccttttattctttctttaaatcccccaggctcacacctttcatctgtctgtgacttttctatttcatttgcctctttcttatatttaggttctcccccacccctaactcagtatccacacttgtcctccctttctatcctcattctggggcttaacacggtcttgccataattaatcatagcctcttctctgaacttctggcctctagtttttcccttgtctaacccatcctgtatttctaaagtatccctcttatcaattctcttcccttttgaatccatcctgaggctttactttgaacacattgcaaatcttccccactctttatcctggcattgaaaaatctccatggtcaggccccatctacctctcaagacatacttcttggactcactttcctaaacttttctggtgaaatgaattctccctttcactgtattccaaaaagtttctgttttcctgttattcagcttttgcttataccagttccatagcccaggacctcccactgcccctaattccctgccaccaataaaatacaatctatctttcaaggtcagtctcaaatctctcctctgttaactcttcccagaggactccagcccatacttatctctttctcctctgaactcccataccactttattgtctgtttcattcatctggcaatcaatcatgcattgccttgtaacatctctgaaaactgtcatttatcttgggtactgtcatttaactgtttcttttgtttctgtgtatatagcgtctccctattacctacaaagctcattgaggcctggagcaagtattgcatcttttttttctactctttatgaaacagaattgggcaactagtaggggatggcttattaatgtgtactgactagtttccaatagattatccaattactttgtcaccactttaatagaccactaaatccatgattaatcttcccttgccctatttgtcaggcattggtggtgacagaagatagaagggaccattagagataaggcacatatgggagaaagcatattttactatttaagcttcaagtaagacaaattgctaagatgctggtgccgagacgtttcactatcagctaaaagtgttccttaatagatttaggtccctggagaagctccacagaagttgtgattacaacctgatacaactcttccaagagagtaaacagggagatttttttcctttctagtttgtgctgggtaatcaatacctaggtgtttaattcaatgaattcagggatggcgcaccaattctctggtagtcaccagaatttctctaggagtttttgcattcctagaacaataattaaaattcaaaacatcctatgcgaccttttatgccaaattgaaaatgttatatgattcatgagaaaccctccagtttgaatagaggttaagtcataggaaggaaagatattggtccacagggacaaagacaggaaaggagcatggaattcacaactttttatgactgcctctaatgttgtaccatagtggcctcattgattggggcgggggcaaaaaggggatgtgcttctccattaggaaaggaagaagaaagtaacaaagaggtaaaattctgagtgctaaatcatataaagatcaccatcaaatgctaagccaaggatctctcaatttaagcatatataacatgggactgagagaggccttaatgatattggagagacctcaagtcagccatcttgtcatgttccccatcattgctatagggaggagaatgtatagttatgagactaagtggtcaaaagcctgagaagtcctcggggagtagggatggatggttcttctctatggcattagttttatttctaaactgcattatcaccaagccacttcacacactgctccatccaaattgcctagaacaatcttctacccattgctagttatttaagacattaggttgttttaaagtctggattcaccttcccctttatctctaagacctttacagcagaactttgcttcaagatgaaccatgtatcattctctgtccaaattctggttccaagatttcctgcagattcatttattcattcaaaagatatttattgtgcctttactatgtgccagagaccgctgtaagtaaataagtgacacagatctctctcctcttggaacttacataaattctaactgtggtagatctatagaagggcaggcagagtgtatctcctgaagtttgattgcaccagttactgcagggagcagtggccagagatttggtaccaccaggtaaaaaagaaccctgctaagctttggagaggatacttattgctcttccctctacattacttttgtagtagacagaaaacagaaaggcaaagagcacagtggtcaaggacataggctttggagtcacatagcctgcatcagaatcctggtttcactactgaatagtgattctgccttggactcgttcctacctctttctgagtctcagtttccttagctatcactatagtcattcagcagacccaagtcaagactgctgattccggttttcctaacctaagggcatctacattagctgctcacatacatcttgagtgactcatccattgggcatacattgacatctacatatcaagtggatatgtatagaagtatctgcaccacatactcacaaaggtctgagtccaagtgaattactcctatttatgaataattctaaagaggttttctgtctataattcctaaacaggtggtctctgcttccatcttattatttccctgctctaaaggtggcttaactaatgcaattaattatttacctattaagaattgtgtggcttctctactagttttcttaccttataaatttctccctgttggatggtttttatgatgttaatccattcttccatgtctttccggttgggtgcagccagagtgatttttcgttgtggtgtaataacctaaacaaaaagccacattattagctggttcccactccataactttgccttcaaacacagtctgtgaactctctaagaaactacacagatgtaccaagcacaacataagccacttcttgaatataagacagacattcccagaaccactcgtagctccttagttacccatccgaaataataataatgctaatagcaataattaacattttaatgccactcactatgtgccaagaactattctaaagcactttatgcatatgatttcattcaatcttcattacaaccctgtgagatgggcattgttatttttcccatttcatagccgagaaaaccaagacaaaaagagttaaatgatttgctcagggtcacccagcaggtaaaaaactaaaccagaattgaaatccagattctttggcttcagaattcattcttttaaatactaaaccatgtaccatctattactcaagttagtttgcctgaaaaccctacttgcttactgctactctgtctacttgaagtggtaaaattgtatgtggttcattagggtgtccctgtttctgtttagtgggagagtgagatgtctaaaaacccagtttctttctttcttatggttagggacaacctgaagagaattttacagttgtctttcttaaccctgcttggcacaagaacccaggcaggaataataagaatgccacactgagagtctagcagatgtagaccatgggcaggacttgatcttttcccagagggcaggagggatcatggatagctacagcatcagtcattgcttccattgccctacttgcctttactataagctccccaagtcttgaagctagagctcaccacaccaacaaggaatttgtttcttcttttgcatgtaacacagtgagattatgtggtcgatggaaataggagctagttgggattgtgataacagccactcctttggtccaaacccattcttgagtggggctgatgttcagtgcttctgtgctttaattaagttaaggggcagcctagcctttatgatttctttctttgtagaatggaaaccaaaaacattaccctataggctcatcacccaaagactcagctttttgggactggtcaacagagccctcagttttaccctgtgtcagggtgatgtaatgagagagtaacaaagcaaaatcttcttcttagacccagccgctctcctttcaagggaggatggaacatgaaccaactatggaagcaggatattgggtctgcagctctttagtctgttaggtactatcccctacatgcctaagcaggaactccagtctccatatcccaccactgaggctgggagaagacaattctggaaggaggtgggtaggagaattcctgggccaccaagctttctatttttcagtgagttttctggtctggattcacttgaatgaccaaagccatgtgacatttcagtcacacaaagccctagacacttccctagaaaatcttctgctttctttgaggcactttcatcagtaatctcaacatggggtagatttcactttgaattagggctcttatctacctcatcagaggagaggatgtcatgtaactcaattatcctgccattttctataacatattagcagtctcttgaaagactcccagtgatactcttctaaatcaccttcactgggaggactgatttttataagtcacatactcccttccccttgaaatcagcttagctttatactggtaataaggaacaagaccatcactttttttcttccctatcagtgggctgctagaaaatgtttgcatgaatgataacactttgggatcaaaggaaactttggaaacctgaagttcaaagaagcaagaagtggtcatggaaagctatcttcccagctagcccctacccctgcccattcagtcattcccaatcttacttacacaaaaactgtggcaaaggtttctacagctgctttctgccacagtggcttgagacagatcaatcgtttcaaagtgtgcaaactggaaagatataagacagagagggacaaggaaccgtctggttaatgatgcaaagagacattaaaaggtaaacacacacacacacacacacacacacacacacacacacttactgacaggcatttgtggcagtcatgatccaatcatttctttggcttgagggctaaaatttatttagcaacatgatttttgttaatgtatcatgtgaccaaaaaatgaaatcaaaataaactttttacagacatttatgtggaattataggaaggcttgagttggtcagctcagaattatttaaacataaaggcttatgctggaaaagataatgagatgtggtctaactagagtcctagagaaacagattgtgataaactcctattttattgggtggcaacctttgcagtgttgctagtcccatccagtttgaggcctgtgcctccttattcactggccatagtagataccatctagccagcagcaggaaatcagtatcatggatacaggcaaggccggtttcaccagtatacaaactgtgcagtcacacagggccccatgttcagaagggcctcacacttagtttaatgctttgttgttgtcatcttaaaattacctcataattttgtctttgagcatgtgttttgtaagtaaagtccaatgggacaacagatcatgcatatgagcagaggagataggcgcattatacatttccaccccatgtcttgttgctccatttgcatttgtgatgcccgtgaacatagaattctagtggacccatgataagtgggagtttagcaagactcaaatcaagtacaagataagtgtgttacatctataactgagtaagcagtaggggagctgacagccctgagaggtcatactttctgttggaaccagaacttgcttcagacataggaaaaagacaatggtttctaagaaatacaaagaaccaagaagccctattgtattctttcttgctcgttacacccctgtgttagccaacaatttctgctaaaaatgatgacatggaaggaaatggaaagataaggcaacccatagttctttcagttaaaaaagtgttggtggaatgtgcaagtatcgagaagtaaaatatgaacagttgagctagttttgtgcagtttttttatactactgagaacaaaatactacgcttgtatgagctactaaacacaaattgtataattttagtgattctttatttgaattaaatgctcttacatttgcatttaaaactggtgttgtatagtgtgcagataaatagtgaaattcatgctaattatttaaaatcgtatttttctttacttagaattgcattagcaaataaaaacaccatgacaagtctttgctttatattaatattttagtataaacataaagcgttatatgttagtagctttaatacaacttccccctgctttttgaataaagggcactacattttcattttgcactggatccccaaaattatagttggttctgggtgcagaagctagctgggaaaaatacaaaaggaaagggatacagaaaagagaaaggagagaaaagtatccccatttgacccaaaagggcaagttaaaaaaagagtagagggcttcaacttccaccctaatgtttgctgacatgtctttacttattagtccatcttcccacacaaaggtttcctggcacccacccattaatctagttgacaatatgctatacattaccgcgggatggtgtgcaaagtagagcttctgtccttgaaccagaaaatatctaagcttccatctcttgaaagagttacagttcttcagcataggtccttccttcaatattttctgaaagatagaagcatggtgttgagcaattagatcaattcataaggtcatatcacttgttttctcagatggaaacagcagatatctagaaggctctatcttgtcacatatctgagaaatggcctgaaggccaggtgagaacacagtgaagctcattcaatcagatgagacattggttacccttggattactcattcaggatgatataggtttcacgtttatcagactatgtggcccaaaaaccacagaggatatctctatttgcagtagagggcagggacatgaacatcataaatataagaacagcattcttaggaaagaatgcgtggtagaggaaaaggctgtaaaggcagattttctggaagtctccagattgtagctccagacagggctctcctgtcagctcttttagagtgttccttttagaatattaagttagatcatgttccttccttgttcgcaagcctccaatagcttctcaacacgtttagagccaaatccagtctttaccatggtttgtcttcagcggactcatgatctcatgaaggagcaagcacataaaaaggaaccacaagaaaactaccttctgattactttctttacatctcatagtctaaccactgatttttcagttacctgctgaacagactgatcctaaccaagcatagagtctacttaccattttcatcattgaggaagttctcacttaagttataggatacaaaccaacatgcaagactgccatttgggagaagtactcaaccccaacaagctggaatcaaatccatacttaatggacaaagggccagactgagtttaaaatcaccacatcaaggctctaccatgaattctatcatctaaattagcattcaccattgggtggctggagaagtattttgtttggcctacctagtgtttttcaaagtttcaaattagttggtaatatttgaaaggtggaagacttcatataaaaattcaggtttcctgtttctttttttttaaaaaaaattagaacatctggtaacattgcatttatattctcacatggcaacaatctgcagaaactgagtaccagctgctcccttcagatggggtgcctgactccagcaggaatttgagtttaggactctgatctaaacagttatttgccattcctgttctcccaaatacacacacacacacatacacacacacacacacacgtactcatacacacacatttatacactcttcaattctctaaccaattggatagtactagtagacagagcctctgtatctcaactgaaaagtcagttcataagcagtcacaatttacctgagccctcttcatagcttatgggagtttcaaggttattgtaacacccttgggatgcaaaagaatggtgctgaggagtcagaacaaagagaacaataagatcttgtgggaaggagggaggttgcagtgagagagagtaagaaattatatttaaattgttgaaattgagtcatccaagagaaaacaactgctataagcattaataatatattgttcctttcccctttctggccaggtggcctaaagtacagttctcaaaaatggcttttggtttttttatcctaaccttctcacctctatccatatacttctccatactaagtcttcataatacctaggcagtcctatttactcctttctgctaaagacttaatttccaaaatttaacggctccaattctgtacaactgaatcaacatccattatctctgcccttttcccaacttgttctgctctgttaaaattattaaatgcttcctttactcttcttattttgtcgtatgtaatgtcccctgtaccagctcattttacagtttttggttggctacttttcccttccctccattcacagtttaaagtgttgcaactctgactgtcagatatttacactactacattctcttggcctgttctgagaagcacttacccttaaagaacctatttttcaggcattgcaagtcatgggctagtaaacaaaaatctttcaatttataacttgtgaatatgatagcccaagaggactcagattttagcttatgcatttgataagctctttaatgatattactatgagcaagaaggagaaattattatctttgttcaagttcctattttatctgcctgtagatcacatccccttcctcagcaagtcatcctgtttggttattcagagcctactcccaacaaaccagtagccaccctcaactcaggggaccccaattaagctctaccactcagggggcccttacagacaatagagctatataggaataagttttctatatctccccataattaatacaaatctgaaatagattctgataagtaaagatgtataagcccagagcaacaactagaaaaataacttttaaaaattattaatacatcataaagcaacaattaaataccactacatgtggattagaatagctaaaacccaatacagtgacaatactaaatgctggcaagaatatggagcaacaggaactctccttcattgctagtaggaatgcaaaatggtacaactagtttggaagacagtttggcggtttcttacaaaatcaaacatacttctaccacatgatctaaaaattgaaatctttgctatttacccaaatgcattaaaaagttatgtccacacaaaaacctgcatatgaatgtttatagcagttttattcataattgccaaaacttggaaacaaccaagatgtccttcaataggtgagtgggtaaacagactgtggtacatccagacaatggaatgttatccagtaataaaaataaatgcactataaagccacggaaagacatggaggaactttaaatgtatattgctaagtaaaagaagtcaatctgaaaaggctacattaactatatcaatacaactacatgatattctggaaaaggcaagactatagggacagtaaaaaaacacagtggctgccagaagctcaagggcagttgggaagagatgaataggtggagcacaggagatttttagggcagtgatactaccctgtatgatactgtaatggtggctacatgtcattatacatttgtcaaaactcatagaatgtacaacaccaagaatgaaccctgatgtaaatgatggattttagttaataataaaaaatcaatattggctcaccagttgtaacaaatgcactgcactaatgcaagacgttaataataataataataataataataataataatgattgtctcaggaccttggtcagtttagtagccccaagcaggtaacaggggaaactgggagggggtgggagggggtatatgggtacattctttactttccaatttttctatatatctaaaactgccaaaaatggtctattaattttttttaataagcaagcaaaaacaggctgggaattctgaaaaagaagaataattaagagggaactacctgctatttaggttttaaaacctagtataaagctataataatgaaaaaaataattaaagggactaaaatgttaaaattgttaaaggaacataaacatatacccatgtgatatggcaggggcataagtatgtggaatattcattgaaaaatacaacaaaagctctgtctgcaccctggctgtttgagggagtggttgtttgagttctttaagggaaaaagagatggcagaaatgaagtaatctgttttatacctgataccccaggtctgagggtatgagaaggggagagtttcaatgtgtgtctaccagtggagatgaggaagatttatttctgaagtggatgatgagattgtggagctactttccaataataaattattattattattattattattaacacattttagattaagtctagaattactctcgcagatactatggcttgtcaacacaaagtttataatcctttggcaccagaacagggttggtagcttgtgggaactgtccttcttttgcctatcaagttactttgtttctgtcaaaagccaaattaccatctggaaactggaaacaggaggacacagtcaaccatgacaagaacagaatgtcaaggctagggagcaagtaagctctgtggttctaaaattgtttagtgagataaacctcttcaccaagttaaaagacccaagagggcattgttggaaggaaccaaatgaagttgtattgctttgaataagataaaatgaagttaaaacctactttttgttaattaagttagaatgcagatcttcttaggggataggcaagggctctcccttcaatgcctcctttcgcagggtgcatgataagagttccttaagttctaaacagaggctttgtgtcatcagctctgaacttccacaaatgcccaaacctggatcttggaaaaggtaaagtacctgtagtccttttccttctgaattctgtcctcctttggggaaacttccctactcacccaattactgtttctaaataaaccattgtttattttgtcaaaaccccaaaaccaataggcagccccaggaagccagtttgaacaggcagaagctaaaaatccattgcttgattgccccaagtcgataaactatgtgcatgtaaaacaatctttacccgcttggggctactaaactgaacaaggtcctgaggcaaaaattggaagaagcaaggtaacaagcaaatgcatcctgccaagggaggcactgaagggagaacccttgcctatcccctaagaagatttgcatactgcttcctggtccctggcctctggcagataatatcatctcattgcctcctcacaactatgcagtatcacgtctgacttccagacagtaaatctgaggcttggtttcccttactttgtccaagtacccacagttacaaaatgctagtggactctgtgcttcctctccccgtgatgagaaaactgggagggcctggttttttagtatgtacacaacaggttgaacacagaccccaccccatccccctgccaaactttattctgaatgacaagatcatagattgctaagaattaaaatgtattctcggcccggcgagcacgcctgtaatcccagcactttgggaggccgaggcgggcggatcacgaggtcaggagatcgagaccatcctggctaacacggtgaaaccccgtctctactaaaaatacaaaaaaaaaattagccgggcgtggtggcgggcgcctgtagtcccagctacttgggaggctgaggcaggagactggcgtgaacccgggaggcggagcttgcagtgagccgagatcgcgccactgcactccagcctggaagacagcgcaagactccgtcacacacacaaaaaagtattctatgaacagctctgactattccatactagaactcttaatgagcttccctcaaagtggcaaatgatattccttgtttttctaaagacctaacattcgttggcgggcgagaagggagttctccagtttttttaaagtgacagtccaagattgactggaagagtaattagaattcacatgttgacagcactttgtaattaataaagtgcttttgcttctcatcagccctctgaagcaggtagtgaaaggcgttttctaacgcaattctgtcctatgaaagacaccctgaaattagcatcttcaagtggcttgcccgaggaaatagttgaaatttttcctctcaaataagatagcccatgtttgttttgcagttttgagactttgcaacatcttggagttaaaacatttgtcagaagaacgcatctctgatgttagtacaaaaggcaatgaggaatgggactccatatgggaaattttgcttggtggccacatttataagcacacagctatttcataagaagggacacacatgtagtcctcctggtccaagctgccacatttctgtggcaatatctgtgatgctgcagatagaaataatttaggaagggctgtagaatccttgtacatattgaaatgtcatgttaccactcgacgcttcttaaaccacagcacactgcaggcagggttcctaattcttcctgccagctctattagacattaaaacccaaataacattatggtttctactattaaaccctcaaggctgattgttttgtggtgagagtgagtatggtgctaattagtctattgtcccgaattcaatcaccacagagatcaattggcttcattcaaattcaagaatgtaggactccaaggcatacgtaattcaggtcctgtgtacagtgttcacacaaaatggtctttgccaaaaccatggcagcccttgcagagaaggctaaagctttggaaaactctgcttcagtttcattctgaatcctctttgataaaccaatacccaaatccattgctcccagaaactcccacaccctggcacaggtagtatctctctctggtgctctgtacaactcagcatgtgtaaattaataaattaatgaggataaacatttccctcaatccatatttataaaatatcttctataaaatatttcaacagagtctgtaaagcagcccaatttcctgtatataattaacacccccctgctgcttaattgggaaagggcaagtacagctgctgctgtgaccttttcctatgcttctcccaagtccctaaagcttctactatctgctacatctgtttttctgttgcttggtgcatttttttttaagagacagggtcttgttctgtcacccaggctgaagtgcagtggcgcaatcatgactcactgtaacctcaaactcctgtctcaagtaatccccttgcttcagtctcctgagtagtcaagactacaggtgcccgccaccatgcctgactaattttttcatctttttgtaaagacagtctcgctatgttgcccaggctggtcttgaactcctgggctcaagcaatcctcccacctctgtaatcccattacagaaatgagctaccatgttcagcctgcttggttcgtttttgatgcataaggctttggggaattatttaccttttcctagcaaaagggtcccctgttataagccaagttgaattccacccccacccactcaaaaagtagacaagcatcatgacatgcaccactacctgttattagttggctgctcttccgttttaatttctcttgttgctcttgtgtaggaggctggatcaagttgggggatgagtaagctatcattcccaggtgagaactgaattattacgggcacaactgagaaggccagctttctgtctatgactccttcagtccaaagacctggaacatctattgtctttgcttgggttagagtgctgggaagaaagctgtttcctaacactcgcttgccaaagttgattcaaagcaactgtgtttgatttggttaaaatgcaactccgggtgctttaggctttaagaaaggtcagacccactgctccactgaaagctttacattccccagggtcctgttgacatggcaggagtcagacagactggctccagcacttactagctgtgtgaccttgggcaaatcacttaacctctctgagcctcaatttccttgtctgttagatgagaataccttacagagcatgtgcctgccactctgtgagtcccttgtcacttgtggattgtggagccaagggctgctgccatcgctctgctcatgccactactggaatcttccctcctggctgtctaagggctgcagcagcaggatgaggaataggatgaccaactgtcctggttttcccaggagtttcagcactacaatcaggagggtcttgggcaaactgagacctcgtggtcatcctaacactgaaaagccagatctttctaccacgcaggtctgcaaggactgtatctgcaaatctcctcccactgcttcctgtgctaaggaagagctatagatgaacgtctgtgtccctgttctctatcagtgaaataaaagaaagttgataatgatgctatacgtatttatttttatgaataggcaaaaactttaaccagttccttgcatatcactaaaaaggtattttacacacgtgagcaaacatatatacacatatattcttttttcttcctgtaaatcgtagcattctatgtacaatgttttgtttcttgctttctacacttaatatacaatgaacccttttagatgttgatacatattaagtggtttcctttctttttacaattgcatagcattctactaaatgaatgtaatgtgatttatttaaacaattccctattgaaagacagtgctttcaaatcttattttattacaaatgacactgcaaaaactctgtatatacatgtcattttgcactggtctgagtacattgataaaataaatatcaagagttgatgactttaaaactagtccgctgggaccataaagcctaaacacctataagttttgggggagccaaaaacatagaaacaggaaacccagtgaaaggaacaatgtaaagggaagcttagcctttaagcctgtgtcttctcaaatatctctgcccctccccccttcttcttttctattactggaattcctagggagggtaaggatcactaattgtttggggtatggggaggaggtgagcaatctgagcccaggctgacaaagttctgaaagtggtaacctggcccttggtaattgacctgggactagctgcatccaggaaggaggaagagctctgctgagcccgcccagaactacttataggtttgaatgctggctttgctgcctactagctgtgcagccttgaacaagccatttcactgcgacaaggggcctactgttaagttggtaggatggagatacaagctctggtctatgttagttcaaagtctgtgttcatgccacaaaactggccttttaactttctgagctaaccgtgaccttagtaatgagtaatcttagatctccctgccctgttagagattatgaaaataatgctccaagaggggctgtgcttactcaagtcaaatagcaaattagttgtagagcactgggcctcaggccaccgtatttcagttgtgttgggactcctcaccaacctccgtaaggtgagtgaaggtgccctataactgcagccattgagatttcactgtattgggaatgcctcttggaatatgtgcacagttacagggctctaggggaatggcatggaatggcatgtgaggaaaccagcaggaaaatggcttgactctaagagtaggatcaaaaggaagggctgggtaagagctttgggggtttgaggagaaaagtggcttatgataaaccttcctgcagaaggttgcctttgctccacaaatccagggaagactcaaagttctgagtaggggaaagaggattgtttctgaccattggagagccaaaagccaagaaacaggaaatccagtgaaaggaatagtataagtggaagcttcatgggagacacctatggctacagcagtagttgctgcttgcctagaaaagaagcgttttggtcacacaaagttcctccaaaaagataccagggtaacttggaccctggtcctcaacctaagcaagatcacagaggtcaggacatcagttagcttatctggtgctgccatcgcataaaaagtgacaaagcaatgcctgcttccaattgccttcttttccattcttttacctgaccataagctaccagagaagaaggttctgctaacattccgtggacgtttattctctcagggacacttccctcactgcttctaactaaccctgggctcccaccaccaagaaacatgccctgtttatcctaaccatctactatgagagctgtggctcctgttgtgactctggcgatggccctcattagaagcagcaggagtagcaatttcttctctaagtttctcttcaaccctccttctccaaaggaagagatttgtttctggctggcaaatgcctgctatttgcccttgctttacatgcattatcttatttaatgcccgcagccacagtcctgtgagggaagtgaagaagttggggctcagagaggttaagtgtctagttctaagtcgcagtgaatagcagagctggggtttgaaccctgatcttttttactttactgtctctccccaccccactctcatatcaaataactacatgatgacggttatcatgatctgacttgggtgtgagatctaacttggggatcacttcagttcacttcttttttcccccaggggccactatttcacccagcaggaaaagccatggaccagtgatatctgcagatttcccactagtttagctgaatttcttgaaggggaccatgtactgcaaatgatttcacaagaaggcagggaaaaaaaaaaacagtcctttagagaggtacctgaaatgtcataatcctgaattttgcatatatacaactttgtaacaatatgctggaccatgcttgggagcttctaaatctggagacttcagcccccagaggtatttaaaagtgcttgcaacctaaagccaaaaaggaagcttgtaaatatgcaaatacagttatgcctcacttaaagacagagatatattctgagaaacatgtcattaggccatttcatcattgtgctaacaagagagtatgcttacacaaacctagatacctagatggtattgcctactacacacctaggctatatggcataaactattgctcttaggctacaaacctgcacaacctattactgtaatgtaggcagttgtaacacaatggtatttgtgtatgtaaacatagaaaaggtacagtaaatatacaatattataatcttatgggaccaccatagtatatgaggtccatcatcgactgagacattgttatgcagcgcatgcctgtatgtaacttatttggctacaactcactcaaacagcaaaacagagaaactcaattttggtgatttctgtgctctggtttttaaaagtacccatttctttccattcatggctttaaatgcctcttagaagtggggatggtgagcccacatcacctaaacacgtatacttgggaagtacatgtttactcctgagctggggaaattgttttattgccaaactggacccatgcagacagacatctgaaggcctgaataatacttaagaatacattcactaaaaagtcctctggggaataagtggttagattataaagaggggatgtgtgggtttggtttttactttttctcagttttatgaagtggcattaccaagaatcatgaggaaggtagacagaaattgatgctagaccagttggttctgtttgcttcttgcagcagtggtggtctagggaagatgaaattcactaattcattaggagttgtgtatgagtggtgggaaaaggagtgtgtgtgtgtatgtgtgtgtgtgtatgagagagagagagagagagatattcagaaagagagagagagactcagagagagagagagagaatgcctctgtaccaccagtggtaggtgagagcaggaggaaagtgtcaggtaaggtcacctcaggggttggattggcttgggagtagaatgggtgatgacagattgatgggagccctcactcaattcctaaagctgtgggtagccttgctgcctctgagcagaggattgtccctggctgaacacaattgcctcacatggagtcaggagatatggtagtttgacagtctatcacacttggagggaaaagagagggaagagaagtgactgcatgagacactagtctgtcaaagaagaaactatgttgtgggccttggttccacagaaattactggccaggtaacaaagctgaaaagctgtaccaatgtgaatgtattcttggtaacaggaggctatcagggacaagcctcctggagaaataatagtgaaatgaagtgctaacagttggtgagtcctgactatgtgggaaggactatgctaatcatgttacattggttatctcatttgattttagcaactctgaaagatagacgccatgctaatctgagtcttggagagatgaagtagtttccctaatgcgttaataaatgacagagctaaaatctctcttgaggtttcacaaggacatgaataactagttatcccttcagtggaaggaaaaaaggaaggtttaaaccactggtcttattggaaattatatcctattctaagtcaatcgacagaagaaggcagatttggcaggagtttggtggtatgaatcacagcttgttggttcagttttgtttttgtttttaattttaaatgctaaagtaattaaagtaataattatttaatttacacagcactttgttggttataaagatattgaagattctcacttgattctgaacacaaccctgaggggtaggccaggtaagtaatgctattggcctttttttttttcaggtaataataccgtgactcaaaaaagtgacttgcccaaggtcattaagtagtaaacttgttctggccttctgacttccagtacaaggctcttttcactgttatcgccacactttatatgttctgtgttgtttgatatcattttgattagtagtccatatttcaaagcctagttttacctttcctgttatcctgcaataaaactctctgccatcatcactggtaaagaagtatgacataatcaagtgtgccagtggcaggcattctcttggttaacgaaagtaatatgacgctggacccaaagggaaattgtcctctgacctggatagctcctagtaataaaaaaattaacgtggccatacaattacgcacaaaagcatcacacaaggatcttactgagaaagactgagagtgcggctctcagtattgcctcccctcccagggagcaacttcccacagcttgttcagatgttttaccctagaacctactgctacctttttcacagtgtttcacctccatttatttccctgttgaaacaccatccagatctgcatccttttccaacttctccctgcaggcaaaaacaccatccagatctgcatccttttccgacttctccctgcaggcaaaaacaccatccagatctgcatccttttccaacttctccctgcaggcaaacacctggtaaaattacactcctctctagccaggctatgtataagggattaaggttgctgaatcctaaatggccactaactacagtaatcaaattctaacacctaccagccagggcttagagcaaggctgactgttaccatctggattttgtgctgctcaactcttgatagcatatccagaagggctgaccataaaagtacaaatgcaataagagagaaagagagaggggtgggagggaaggaagagatcagtggtattataactcagtctgataggcctggaaagggaggaggaagaggagtaggaaataaataagaataggatgagcatgttgcattggagggctagaggtggcagcaaacactcatagacttgtagatgacaagggatgcttattttcccatcaatgacacatgggattcccactggtcctggaaagatctctgagccaccatttcattgactctgagattgtgccctaatccatatgtgctgctccctgtttaaaatttctgggaagaggcagtagtggctactgggaagagaagggttatcagctgcaatctgggggacagccagtcttgaatcacacacacacaaaaaaaaagcaaaacagtgggcaaatttgtcctgtgggggagaagaactgtcttttaattggaaacagggcctaaacaataaagcttaataaagggaaggagcaagggagatggcaggggagagtccagtttgaagcaaactcactaacagcaatgtacacacccaaaattgaaacacaaataccatgacacagctaccctcctcttgccccttccacccctccatgcatataattaaaaagcaatgttctaattagactggcatctgatatctacaccttttctgaaatattgtgctaggccctttgtatacattagtgctaacagtcacaacaatatgtgaggtagttattatcatcctcatattacagataagacactgaagctcagaatgttcaacagacttctccaagaccacacacagttacaaagagggatgactttgaactcaaatttgtctgattccaaagcctagacacatttctactcattatatcacacacactgccactctttcctggaaagtggggagtggtttgaggtgagagagggtgaatagtttgcaaaaccacgagacacctgaataataccacttcacagaaacatttgcacacaggtacaatatgggcaccaatatggcacctgggaaagacagtggacttaatggattctgaacttcatggagtttagccaccagcagtaacctgctgtgtgagcaaatcctatcacttctccaagctgccatctccttgctaggaactatggataaagatatgaaaatttggcacttgattcatcaagggaagccaaggcataacagaaaaaacaagctattaatatcgcttaggtctgttgccataaagtagcctcctacttaatttaacactgcggggatagaccctgggcccaggaatagagattatttcaaaactgagcaggccaggaaggcaaacctcagcataaaactctctgggtaaatcacaaatatgtgtcatagccaagttatatctgtcaggcacagtgcccaaagtgccacaacttacccataattagcacttgatggatatttataaagtgaaattgaattggggaaaacacatctggagaggacaatgaaaaaggtattctcaaatgttcctggattcatttttctatcaattggctcctaaaggccagtcactattggaagaaatacactgaggattcttatattaatatatccaagcacatatatttatgcaaaaccaatatagtacagcaaaaaggagtgtagatttggactcagataaatccgaatttgaaacacagcttcatcacttattaggtgtgtgtccttgggcaagtcatttaacttaaaaacctttgcaattttatctgtaaaaatacacataatggcattcaactctcagtagggatcaagataatgcattaaagtgcccagtataaggtagaaacgcaatacatatttcttatttctttctgtgaatatggtggctatatttttgacccctaaattagaacacaagtcttgtcaagtataagtgtatatgtggttgcaacagggtagtgggggctcaatttgatattagtgttttgccccaaatttggaagcataatttacatataaatagtccaagcccagaaggactttactaccagaggttagggtacttttgatttgtgtggattagtccatgcaagcacagactctttccttcccatgagtaacagatcaaagatcactgggaaaagaaacaaagactataaatagaaaatcaaatttatgtctgtgcaagaatttgtgcttactgtagacactcatagtgctaggactcatgaggtccccagagaaaaaaacagaacctattacatcagaagggcttctgatgataggtatgaagacttaaggtgtgttgaaagaaatgctctattgaagcctggaagagaaaccagtgttagaataaggggatgagaacagttagtattagtgaacccaagtgtttgtatctctttaaatttagcacattgacatttcgaatctaatgctctcgaatgtttattattaaaacatcgagccaatttttgaaggccccaaaaaagggctgagttgaaaatatcctcttctgttgtattccatcagccacagttatgggaaacgtagtttcaagagctgctataatctgccataactgaggcatcaccattcacctggtgtcaatgtattctagtcatagcataacgtaattctgggccaataacctaagaggaaagcaatagcttttagagtctaaccttgcaaaccccaaattagttacatgacataaaagtaaatatcacaaggccatttttccacgaaaccaacaatgacgagcagggttttatcataccaatgagtaacatctatgactttactggacaggacctggaagtctacaattatatactacgtaacagcttctgccatgcacttagcctaaaacaaaaatccaaccctttcttattctattatactttgtcattcatgtgctttgggctctcaaggaaagtctagatgtagagttatacagtgacaaatggcaaatgcatcttcttatttactgcatgcctttgggaagctaagagaattggagtgggtgtcacagtaaaaaaatccgtctctttgctcatggctatatgggatgactgtatagttaacttgtcccctccaaatggctgttcttacctttcctagaagttcctcctcttccatttacctttgatgcagaggcaggaaatgctaattctatttagttctcgattctgtcaggagcacttgaagatttgctataccaacaaatcttttggaaaaccaaaagaacttttaatgtggggaagtgagtatagagtaggtgggcatagcttatgctaataaactttctctgcttattatagagaaattagctataagggaacaacccatttgccttcaatcctcatggcttcctggtgagcagaacttccactttagtgttcctaacttgatgagctttttgacttctccaggtctttctcacctagagacatggtgaaactcttttccaggctcatgattcactgaactatttttacccaggagtagcaagttacataatgagaaataacagggaaacatgaactgaaaacctcataaactttaagtaaatatgaaaggggacagtctctcttacctcaaaatgtataaagtgcatacacacactatctcctcattcaaggactcagaggtgccttggaatccctgtggtcaatcgtggtttactaattgattcccatatatgaatgttctccaaatagcatgtttggaggtaagaggacattctaactgatggcctgaaactaaggtgggtacacgaatatttggatgagagaagatagttctggaatgagcgaatagtagaatcaaagagagaagcagtagttaaaggaaaagctgtcagtgaaggatttcaggaaggcaaaattccgtgtataaaaccttttactgtatggaaaaaaagcatcaagcacacgttttccatgatgcttaaaatgttttatacattctgcctgatttgtcctttcaacgtcccacaaaggtaattgaggaagtaagttatcattttcataactcattgcctcagtagatacacttagagagtgctttctcttccccaagtttaaaatgcagtaaaatgtcatattttcttaatagcatctatttctaagaatgtcaaagtatgttacagaccatattcattttgtattattgccatttatatggtttttaacagaatgtgtgtgtagctatatattagcttaagtataaaccttttaatacattgatataaataaataaaaatgatgtcatcttatgtcttcttcctgggccaaaatgctttcagggtctcattgatacacttcaacaatggatcttgagaaatttcatagataatattccttgtcctcttgttgagttctgtgttctaatgcaacctacagccccaaaagaggcttcttgaatcagaatgctcaattaatttcctcaaggtaaatctcacaaggccatttcttcacataacaaacaacctagagcaactaagagctaaaaaatatgtgaaatgcacattttcaagtctcataacaggcaccctgcttaagttgggtactttgcttgaatccaagatataatgccatctattttctgaatggaatatgaagtcactcaggtttatgtaactatatttaaatgaaagcataaaacacattccaaaagccaaatataaatgtgttttgattagtcatgccacaactgagaactgatgattacaaaattctaaacaaacaaacctattaaacttcttgattacagtttaacaatggggctgtaaaaccctgggctcagctgtgtcaaggtacccccttgacaaataagaagaagaaacaacactatttcaggacacggtcaccaaaaaacaaaatgtgtgaagctgctctttttgacctctctccgtctcaggatgatgagacagattatggggagtagatctgtgtgggttgtggcctcaactctaagtgggaccttgcagaggattcatgtatgtattacatttctattgttgagtaacaaattaccacaaacttagtggcttaaaaagtaaaccatttattatctcagtttctgtaggttagaggctcaggcacagcttagctgagtcctctgcttcaaggtgtcaccagactgtgatctagttatcttccagggctatgttctcatcaaaagcttggctgtggaaaggtatgctcccaatctcccttaggttgctggcagaattcaattccttatggttacaagattgaggtctcagttttttgctgcaggccatgcttagctcctacaggccacccacagttccttgctacatgggcttctccaacatggccacttacttcatggctgcttatttctacaaagccagtgaaagagagtctgactagctcgtctactagcaacacagagtttatatagatacatatagtaacattatcacaggagtaacatctcataacttttgtcatattctgttggttagaaacaagtcacagaaattcacagatcctgcctacattctaggggagggtattatacaaaggggtgaacaccaggaggcagggatcatttgaggtcactttggggcttgtttgccacaacacaccaacaattctaccctaggaaacttcaagtccagtggcataaatcctcccatttccactgtgacatccctatgccagagaactaacatcttttacaacagatgctgtacttttaaatatactgtactatacttgagcacaaaatgacacagatagaaccaaaatgtatttttaatacataaaacaaagaaattatgtcctacatataaagcaaaatatttagcatccaaaaaatgttattactggggtttaaaaaaacactattgctatttttaaaaataattatagactcacaggaaagaaatgtgcaaagaaatgcagagggaggttctgtgcacccttcacctagctcccccaatgttagcatcttgtataactatagtatgatagcaaaagcaagagaatgacattggtacaatccatagagcttatttagatttcacagttatacatgcactcattttgtgtgtgtgtgtgtgtgtgtgtgtgtgtgtgtagctctatgcaattttatcacatgtgtagccttgggtaactatcaccacaatcaagatactgaactgtaccgtaggcacaaaactctctcctgctatccttctatagccacatctactccttctgccccctcccatccctaatccctggcaaccacaaatctattctccttttctataatttgttaattcacaatgattacataaatgaaatcattcagtctgtaccctttcgaggttggctttttacactcagcataattccctttgggttcatcaaagttgtgttgctgagtagtattccatgataagaatgtgccatggtttttatagcctatgggtagtctccagtatttggctatcataaataaagctgctatgaatatttgtgtgtacatttctgcatgaaaataagttctcatttctctggaatatatgcccaagagtgtaattgctgggtcatatggtacatccatgtttaatgttaacaaaaaaactggcaaactatttttgaaagtgactgtatcattttacatttccaccagcaatttatttttttaacttttattttaggttcaggggtacatgtgcaggtttgttatataagtaagctcatttcacaggggtttgttgtacagactatttcgtcacccaggtattaagcccagtactcaacagttacttttttctgatcctctccctcctctcaccctccaccctcaagtacgccccaatgtttgttgttcccctctttttgtccatgagttctcatcatttagctcccacttataagtgagaacatgcagtatttggttttctgttcctgcattagtttgttaaggataatggtctccagctccatccatgttcctgcaaaaaacatgatctcattcttttgtatggctgcatagtattccatggtatgtatgtgctacattttctttatccaatctgtcattgatgggcatttaggttgattctatgtctttgctattgtgaatagtgctgcaatgaacattcacatgcatgtgtctttatggtagaatgatttatattcctttgggtatatactcagtaatgggattgctgggtcaaatggtagctctgttcttagctctttgaggaattgccacactgcttcccacaatggttgaagtaatttacactgccaccaaaaatgtataagtgttcccttttctccacaacctcaccaacatctgtaatttttttactttttaatagccattctgactgatgtgagatggtatctcgttgtggttttgatttgcatttctccaattattagcaatgttgagcatttttctcatatgcttgtaggttgcgtgtatgtcttttgaaaagtgtctgttcatatcctttgcccactttttttttttttttttttttgtaaatctgtttaagctccttgtagatgccggatattagacctttgtcagatgcatagtttgcaaatatttttcccattctgtaggttgtctgtttactctgttgatagtttcttttgttgtgaagaagctcttaagtttaattagatcccgtttgtcaaatcttgcttttgttgcaattgtgtttggcgtcttcatcatgaaatctttgccaagttgtatgtccagaatggtattgcctagtttgtcttccagggattttatagttttgggttttacattcaagtctttaatccatcttgagttaatttttgtatatggtgtaaggaaggggtccagtttcaatcttctgcatataactagccagttatcccagcatcacttatttaataggaagtcttttccctattgcttgtttttgtcagctttgtagaaaatcagatggttataggtgtgcaaccttattcctaggctctctattctgttccgttggtctatgtgtctgtttttgtacctgtactgtgctgttttggttactgtagccctttagtaaaatttgaagtcgagtaacgtgatgtctccagctttgttctttttacttaggattgccttggctattcgggctcctttttggctcaatatggatttttacatagttttttctagttctatgaataatgtcattggtactttgataggaacagtgttgaatctctaaatttctttgggcagtgtggtcattttaatgatattgattcttcccatccatgagcatgggatgtttttccatgtgtttgtgtcatctctgatttctttgacaagtgtgttgtaattgtccttgtaaaggtttttcacctccttggttagctgtattcttaggtattttattccttttatggcaatggtgaatggaattgcgttcctgatttggctcttggcttggctgttgttggtgtataggaatgctagtggtttttctagattgattttgtatcttgagagtttgctgaagttgtttatcagctgaaggagttttggggccaagactatggggttttctagatatagaatcatgttgtctgcaaacaggatggtctgacttcctctcttcctatttggatgtcctttatttctttctcttgcctgattgctctggccaggacttccagtactatgttgaataggagttccaccaacaatttataagtgatacagttcctctacatcctctgtagcatttggtgttgtcattacttttttattttggccattctaataggtgtatggtgacatctcattgtggtcttaatttgtatttctctaatggctaatgatgtggaacatctttgcattttttgcttatttgctattgtatatcttcttggatgaaatgtctctgtgtgccttttgtctcttttttaattagattttttgttttttaaatgttgagtttttagagttatttatagagtccagatacaagtcctttgttggatatgtgacttgaaaatattttctcctaatctgcaatttgtctttttatcctcttaagaagttcttttacagagtaaaagttgtaaattttgatgaggtataattgatcaattcttactgttctggctcatgcttttgatagcatattgttatatattgcctttggagaaacgttcttcatgaaattctttctgctgtctttcatgcttttggaggcttttacatttatgtgcatacatgtgtgtatatgtatatgtgcatgtgtacgtgcatgcatgtgtgcatgtgcatgtacgctgactggtctaactagaaaagcttgagcttattgctcatgcataaatgctaatgcatatgtactacgatggaattcatagaaccatagctcctagagctgaatataatactgtaaaagatattatctagtgagggtttatttaccatgcctgatgtgcatggggaggaaatagctcataaaattacaattcctcttcaaattatactgctccatttataaaaattaaatagggaagcatgactattgtgtgtgtatatatataatatatatatatttatatttatataaatctgtcttgatttatataaatgtcttgaaaagtatgtggtcatacataagtcaaaaatctaaaattcgttaatgtctacgagaagtagtatgtgtgtgtgtatgtatatatatatatatattatatatatatataatatatatatattatatatatatataatatatatatattatatatatatataatatatatatatatatattatatatatatttcacagaagttgagatccaaggccactgtacaacaaatgcatgacacacctacttaataaggaaccaacatgaatcaaaattcagtaaactggaactcactgcagagcactggttttaggtgtttcatacaaagacaatcagattctatgagcttacattgtcaaacactgactagttatcattatccgccaactctcaaaacccaacttggcttaaggtagggctagatttctgacactttcccttgggttgtaccaatatttaaccaatttctgttatttgcaggataatcctttgtgttcagggcagagtccaagtgacttgcttggatttccagtgagaaattctcttgggaaggagggggagcagtaactcagatcttctgtattcttttcggaaatctttcaggacataaatgttgcttttcaattattttttttaaaaaaggagcgacttaaaggtgacataaaaatagcaagtactgaacaaactacccccaccccagtcaacctccagataaatgtggtggacagtttatttgggacccttaagcaaaaacatctgtaaagatcctttgaccctttgttaaatgtaaaataaatggatctccagccacctggacaactcaaatgcaagagctatttgtgtggtatttctaaacatcgaaagagaaattaggcatctggcagaggttacatccattttttgggtgggaatacttttaaccttttattaaagctcctttctcttttttttttccatctcatacccagtacttccatcttgcaggctctggccccaataccatttcctggatcccaaatggctgatctgaaatagggctatttgatcttctgggagctccccagatagttctgatttatttatttattcattcattttttgtgatcagcccagtctgcttagggacatctgggggtgggaagtgctttctaaacaaattactctattaattatccgagaatgcccctcacaggacttgactaaaagacataatgctagactcctacacagaaacactaactcatactagtaggaagagaaacacacatacatcagcaggggcaaatccatatgagtgtgcataagtatacacacagccacaaatggactcaataatgcatggagggcgtgaggtagggagtggtgagcttcaaaatagattctcttgttcttccgagagtctgtaaagtctgcatagctatcaggagctcacaatgagcactggatgaccagtatcccttaatagtggtgactcagaagatcagatgcctactatgagtcacagttgaaggtgtcccaacagtgaaccaggttaagggcttctatctgctttctgacctagaactccccctgcaggatgccctaggaataatggtcttcattgccccagagggactgcaggaacctgtgaagcagggaggaatggggaagtgcctctgtattcaccctgataaaataattgccaggatattagaatgaattgagtggcatcttttcctgtggtgagtattggggccttttatcccagagcaggggcagggtaaagtagaagtcattgttgtcagcttacagcctcaacagcctgcccacactagcttgcacacatcagtttccttctttgttgagatcaccactacattgcaggaagatcaagctctggaatgacagttgtatgctaaaccacatggtgacaccccaaagcaagaaccatgtgccctttagggtggcagcccagggagtagtcagaggggagatagcggaagtaacagcatttgagatattacccatttggagcctcatctcctccctcactcctcctgtttttcccctccttaagtggaacctgggaaagatccacccaaaggtgatgaaatattcaaatacctcatcaatagccatcccacagaggaagtgtctgctgtagtagaagccttggttgaaacatctaagacaacgttcaatggtattgggactagaagacactgaggagagacaaggcggactaatttattgtttatttttcctccctctgcgcagagatagaagccacatgccagagaacagaaaccctaagctgcctctgaggaaataatgtaatgggtcatacaaagactctagtgatcagcctccctagagagaaaaggcaatgatgaagcacagtggcttcaagagctgagccggctcacaaccactcctgtgctactgtttacaccactagtaccacgaccttgctcagacacgcatggggtatagagggccccaatagcacctacgactgagttgaagctttcttgactgacttctccagctacagtactttaacttttcccacgaaagtccccctggcaactgagagtcaatccctcgaattgactttagcctagaaaggatgactaactgtatgtggcgttttttaaatattttctttcttctaaatcatagaaaatgtgtagattagccttctgcgagatggacttgagaaacaaggcacacattgttgtcctttatgctgaaatgtagtacaggtgagagtgatgactagtcatgtatacacatggctgcaaataattgtggtcactatcttccatgctctacacacaaaccctatccttgaggccagccttatccactactcacactagatatttttcatacttttgcaactaagattcatatttggctccatatgcaaaaagacattctgtttctgagagttcctgactagaacggtctgcacatacattctcatttgctggaagtccaaggccaagccatgctgtatttcagtgtgttccagaaagcttttcttcatcctctaggcttctgattacttgaccacatcatacactggctgtttagtttccaactgccatttataaaacacagagcaccaactcagatgagtggaactgtgatgggaacttggatgttgctgccctgccttttttatctggctgaccttgttccgttggtgggcttcaagtggcagctttccactgtatacagaacttgatcctgttgcaggatgacacataagctaggtttgcctcacacttcccagaaggtcagtgctgtctcttcacaaccatttataatcatttgtctgtcttctaaggtgtatgcttagcaaacacagccatttgaccacagcagtgtatacatgactatccctggcattcatgttatttttagactactgagtcaaagttcttcccagaggacaagaggcatgctctgccatgagcctcctctatgaaatctcaaggctacttgagaccatggattaaatacctaaatctgtcttcatttcacctagagatggagagttgactatagaagatatcatcaactgtgaggagccttaggatcttggagaccttgtcagggtagccaaacttgatatcagagctcaggtctcttaatagtagcagatgttgcaatgtcaatgcataaacagaatagccttgttccctccaattcgtcttatggatataaatccatgcatcagaaattgtgtctgccatgtttgttatgctgcaatctcaagttacaaggccatcctaggaaaatatagttgtcagtgttctcagattcagaacaactctaatcaagaggggtggcagggaggaaggcaacacaaaatagttttcttctctaagtgaaaaaataaaaaaatggggctttgaaatttaatggcacttctctagtcctctatgaatgggaaaaaaactctatgtagatattgaattaatgcctctatctacttgaaaaatctacctaggagagactccaagtgaaaagagcttctttcaggacttaagtttctccagcaatttcttcagcagttggaataaagttaatacaaaactttgtgaactctcatacattgatcatgaaaggtcaccattctttgctgaaggaagttcatcattttccagaatgatgaaagttcatcgtcatcctcaatgattgaaggcaggtcacccaagtgttactaatattcttgctagagacaagtgtaaatgaaattgatgccaattctatgcacactggaaattatatatttatatacaatttatatgtagaatatatatatgagatagtgattagtcagatattgttagctcagatgtcgggaaagattaaaataatcattgactgaaaactcaggaaatcctacaattactaatatcaatgaagtatctaccacttttctatgaaaaattatggcaacaggcaagaacttactatgaaaaaagtcagagaggtacatgctaagtactcagaaatacttgttgaattgaattgtggatctttctcttaacattcccctttaaccagaagagaaggaaacagcagtaattaaaggggatatatgactctgatgttaagatgcattgttaagatagccatccttgttgttctgactttttccttattctgcatagggcactcatccttttgaaaggaaaacggaccagaggtcatgagcaagtatagcatttgcttgaaacaaaatcagtgttctccacattgtaggggctaccatagttttaaagaatcagttaggcacaaggcactgaactaagaacttgatatgtcatttgatccttagaaaaaccttacaaggtgggaattattagactgatatcataaataaggaaaatgagacgcagaaaggtgagtgagggtctttgcccaaggtcacagagctaggaaatgacagagctgggattgcaacccaaatgcgtctgactctgaagcccgctatattgcactgcaactctctcatttaccctcacaccgtactttctgtaggtagaagcaaatcttaactccattttatagacaaggacattaaggcataggacagagaagtattattccaaagagtctaaaacatttcttctttcatataatctaggctccaaagcggggaagtgaagtaaagaaatcgccttcttcactaggcttctaccttagaaaaatctctacccagcaatcagtcttagtgacataatgctcaacaagaggcagtgtacaaaataatccaacttgctgtgacaacaccacattgtggcagagatggaagcacagcacagtcctgagatgcacttgttaaaaaacagtagtaagcaggcagaaatctgggctctaaccctgtccccatgctctttactgttttttagtgaatgaattccaccatgtattggtgtcacattcattttaaagctatgcaaagtgctttacagaattcataaggctttaaaatacctttgagcctagaattttaaagtgcttcccagatattctatggtgggaaatatgcttgtttgcaaatggataaataagaagtgagaggttaaaagatttatctcaaatcacaaaggcacagctaggaatagagtcagcctgttaaatctcaattctgggcccaaagcactagactggtgtgtttttaatctcttaggaattgtagaaccttttgagaattctgatctcaggaagtctcaaacagtttaaatgatgaatcatcattataagcattttaaaagttttaagccttttaaaaaatcaatcattacaaccaccttaaaatggtatctcatcttaagtctggatttgtttagccctaaagaaagtaattagtcctaaaaggcaggcaagtggcccccattatcccactttgtttagaggaacctagatcatttctaggctcaaagaggctgctttgaaaaccttgtattaattatcttgaggtggactaggaagtggttttgtagtctggagccttgggcctcagtcttgactctgatcttcagttaagtttcctttagctttggttttctcatctgcacaatgggaattaaatgaatatcgctaattacagaggattggggtgagaatacaaggacataggacatgggaaatgcatgtgtataaggcattagagtatgatacaaaaatcaaggggtagtttagaaagacaactacattttttggctataacatgcctgattgggaaggtctctgaaggctcattctgcaatattataagcctagagagaaagccaattagaagtagtattccttacatgcatgacaaggccttccaaaagtatgacaaacagacatatacaggaaacaaaactgagactgaaagattctcttgaataccaaagactgaatatagatgttccttcatgtagcaactggccctgtataaaatgcatgggggaattagctcccttctcagacatggacatctctgaaagccaatcaagatctgatgctctcatggcagagaaagatggtgcatagaaatgggcaatccagaggggaaacgaaagcattgcagaccctcggatggcacccacaaagaatccagccagcctgagaaaagggtgagttgcagagtggagagaaaatgagacattatcaacatcctatgctacctcctctgaccatttctttctccttactccactattcacttgttctcccccagttctctcacaccttcaggcttaaaaaaaaaaagaaagaaaaagaaaaaaacagttttcccatctctgttcctttgctcacaccgttttgcttgcctagaattcccttctcatcactcctctcagcacctccacccaaataagaaaaattctggaatgttcttttactcatcactgaacccaagtctaccccatcttgctaggccccaatcaattcttatctcctttaaatttgagtttctcttgtggctatattcattttctatttgagattacagttatttgtatacttggtcttatttcctttacttgactataatttccttccttcaggcaaattacagttattggcacagcgctcaacacagagtaggtgttaaatgaatgattttagattatcattgcctgaggtaagcaggccaccatcatctctcaccttgatttctgcaacagcccaagtaacctttctgcattctgtattgttcccttccaatctatcctttacactgtcacaatatatatcttaaaaacagtactttcattatgttactctcctactcaagaacattaattaatatcctgctatacataataaggtccaaatccctctgcctttctctcaaagctctttgatatcagctgaatagggttcttgctgcttccaggtatttgtgtatgttgcttgctccctagtagtggaatgctttctcctctccacagatctaaattcagttgatctcaagtccatcaggaagccttccctaacttgaatttggagctagattgtcagtaggactaatgcaagcctctctttttttgtgaggactgagaagcaacagctaagctctgatgttcctttggcagttcaagttttatctaaaatagttttctactaattacaagaaaagcctcctccatcctttatttgtcctcttttataattctacagcattattctctgtaccacttttcctgtaacaaaatcatatctttccttatattgttatgtacctgtctccaatgtacacgttttgtctttcaaatgagattgcagaatttgcatccattttgttctttccacaaactggggacctactaggtcttcagttcacactttcaaacaattactgatttattccctgattattctgtctggccttccctttgtttcctccactgtctgcagctgttttaaggagcttattattcagttgatacctaaaagatgatgttgacttggtaagaccagttttctttaagaaagtcctcactttccctcaacattttcagagcaaattttataatgctctgagtatattttagcttgctgtctttggagatcttttaatatctgtatctatctatgtctctatttatctgtctatcactgctttgttgttcatgttaattcagcagttattaagtataggtacttaatacttcacactatgtgtgaagaacattaaaatagaatttttacatacagaacaatatattctcattattttaataaaagagaagtattttcatactcctcctattaataactggataaatattaaccttcattactagtttccctaagcgcaatatattccaaggcttataaataagcagttgtgtaatgagagaaaagacacttgcattccatccaatggcaacacattaataatattcccctcctttcaaagccatttggaggattttcatcaacaaagagagaatagccaaaggaaaaatagaagttattgaaaaaattactcaggatcaaccctttaaaggaaaatgttccttaaaaaattacacattctttctctcctggtttgcttccaatacttcaacctctaattcagtatttttcccctccccttttccctaaacattatttgcccacatttgtctacactcccttattgtcataatataccaattttgtcaaagcaaggcacttaactgccatctgctagaaaattgccacaatgaatatatacatctatggtgtctacaatgtgaaaggtgtcccattagacatgacaccctcatatagtgcacaacctgtacaactttatgtggtcatcttgccctgcagctattctagaaagggtagaagttttccttctcatttaaaaggaaaagttgttccttctgattggaaacaaggtgcctgttggggtttcctgctctctgattggagacttcatattctcttccctgaccagaccatttcaaggtcagggtgctaatctgatcagaggcattggtgaaacaagttaaggcttttcctgtaattagtagaacgctattttagataaaacttggactgccaaaggaacatcagagcttagctgttgcttctcagtcctcacaaaaaagagagagccttggaatagtcctactgacacctagctccaaattcaagtgccaggtacaggagaaatttgacactaaggtaatgagtcaagagcttttcaattaaagtgaaaagcctaccagaaatagattaaattctgattaacagttaagattagtgaaaaggttaccaaatggtacttagttatttgtttcaacctgctctccatatagtacacttaaatgcaatagtctttagtgttattatgctgtatttagtgttattatgtagtattttaataaatgtgcattttggatttttttaagaactggggagataaatcatcattctcatttttattaaaattaactatgttcatgactgaagactagtaattcaagaccacacaatcaatatgggcctcctcctagtacatatggtgtgtctgtgtgagttagaaaaatctataatcctctgggaagatatgaggcagtcctgcttaccaccgcctactggtaatgcaaaggtttgcacagggtgctatgggaaccctaggttctgggtgtctagcccggaggggatagcagtgaaggcctgctggatgagactgctgagctgagttaatggcacatcactggctttatttaagagacataaaagctaagccacagaaagattaagcaatttaccccatattgcaccaccatctaaattggagtccaccaaagtgaggtgacttccaatctaagaagagtccaaactcttcaacttcttgctacaagttaccacggagcaaagatttttgtgagaaaattccatactgatatgcctcacagacacgaacattagcatattaaaatgcaggcacaccaaaataacccagtcttgcagcattttaggacagctcattaacacctataccacaatcctggcaacctttagttcttcattttatagttgctgcagcttgctacaggaagatgtattgcatcagctcaaacttccttggacaccaactttaagaggcctgagtcattcaaatcattacccaaagtccttcgaccatcaaaggcagcaaacaaaagtaccgctaattaataatgtaattagggtttattataactagcatacatttgttctaggtctgattcacccttgctttgaactggctttgtcctgtttttatctgtgcttaattgtactgttttatgtgcatttgattttgtaagatacttcgtatcttttctggatgcaggcagagtgtaaattctaaataaataataaacaacggattaaagttatgtagaattagctcttttatgtgcttcatgtacagtttatagtacactgaggccccttacaaattcaatgtggatggtacgtttatgcctattttataggacttggaacaattttgctgctttaaatgattacagaggcttacagttatatactagcttttaccacatatttttagttatatctacagtttatttggtgtagtgttctttgtcaggaacacaatccccaaaaataataaagagctataagcaaagacagtgtgcattatgacaacccactttatgagatagttttaacacattccaggttaggaggagggaagaaagaaacttgagagaacggccatgtttccgagaaagtatgatctaccttctggaatattacaggccaaaatttaaaccctgacttgtttctttctttctttttctttttctttttggtcccatgtgctcctgcatcaccagcctccttgctaaggagctagtaataaacagggagcgcaaacacactctcctcttagcctaaaataagcaattgggaagctaagttatttacaaacccattttagcatagaagaggagtgataaaatactgcatgttttatgttaagtgtctggctttcatttattatttcattgagaaaaacatgagattctactgctaaaaaggttttaaaaccactggactacctgacccccaaaggctctttccaggacattctatgggtctataatactgaagataaaaggcttcactggattttcatcatggtttcttatttccactatagaaaacactgaaatgaaataggaaaaaatgtcatagagaaagcagatgagacttttgtaaccatgtaatgtggataaaagagggcctgaaacagcaggaaaaggatactagataatatatttattttctcccgttttagcttttgtagtttaaattggaatttagcatacaaataaattgaaagctggatagtttttaattatatgccccatcagccaaccctccacttcagccatgttatactaatcaacagctcttcaatgattgcacaacattaatcaggtgatatacaaaattttgtcggttgcgtttatttatttatttttctgagtctacttgccagggaatctgttgtctttaaaatttcaataggacttgcctcatctactttattttttacaatctttcaatcagtaccctatgattccctggccctggcctcacctgcccaattcaagtataacttcacttctactgatacttttcactgtcactgcttaatttaataccagttttctctcctctctgggtttgagggggatatattgttcctacgttcctcaaacaacttcttcattttttcccctaaacttcttacatcaaagtgaatttgctatcaggcagtctctcatatctgcacctaatccatctctgaaaacttgttggatgatgaattttgaattgtaggaacctttgttccattatttaggttggaaaagcgataatgcattcccaccacatctaaaagtcccaatatttcttcaaatatggtaaaacactgttaaatgcccatgtaacaatcctccaaatatgtatcatattataaagcatttaaaacaccaagtacctaattattgaacacttaacagacaagcagatactttgtgagtaggtcacaataatgccctgctatacggagtacaaagtacttcccacacaaaaaaacaacctttcaagctgtttcaaaggtctacctttgtgtttcatcattttcatcattagaaaaaaagacagagaaattcaaaaagttcagtgccagtaaggaattgtggaaaggcaaagtaaggctttttcaggaatttctagaaagaggactcacaagtgcgaaggaatataataagaaagccatgaagagaaccactaatgggtactttgattccatgtgaaaccaaagtgaagctctcacatccaaaaaaacaaacaaaaaaaatgtcaccaagttaagtaaattcaagcagaggagatcataacaatgtcaaaattatcattttaattagtcttaacagtcaaagagagttaagtagtttgcactagaggtgaggtagggaagaaagggacagtaatatccgaattctgggtaagagaaaagttgttttactcaagctctgcaggagggaaattgtcacagtaagcattaattgaggttagtgagaagggtaccaacttgctaattttctgaaatcaagaatcttgttctgcagcttcatttactgtcctctttattgtttacacttagctgttttaataaagctacatcatattttcctctatagtgcacagtgatgtgaataaaccatgaaataatatgttaaatgtacataataaatgcaagtgacacttatcaagggaaaattaaaaaccaagtttattataaaatggaactgagaaactactcttagagttggggttcagaggacatcaccatgatgctggagctgacttcaggacagtgagggctcaactgacagagcccagagttcatgaaaactttctgggtttcaagtctctttactgacagccaaggagcttaacaatttttgctcagcaggtacctttcatttcctgcgtcaagctgcaaaatcccagaagagaaaaggtagagacatttgctgcaggagaaggtaaatgaatgaacatccaggatttagtcctacaagccatactttcattcccctctactcttggaggcagggaaaaggctcagtcctcagaactactgcctcttgtttcagaagaacactgcaaagctctggatgtgtgggtgggtggggagcattaagcatatctctcagtatcctacacgtgcttgagggaaacaaggggtaagaatccctgtcctcaggggccaatatttcctttacaggctctttaaagcaagaggcttaaacaataaatgcctataatgctttggaagatgaaaatctctgaagtgctactgaccaggctgaagattctgatcttactcaataatgcattacacttcccttttaaattactgattcagccttggttgggttgtatacagtttattaactctctcaagttttgatcacacttggttaatgaaagctggatgaattgaatattctatttccttataattgtggataatgtcctcatatattcttatttcccttctgggtatggcatacccagtttagcataatgctgtaacttcttgttaaagagacaaagccatcactaattttttttttttttggcatatagttaaaagtgactcagaaatttagattttttccctttgggaatttaacagtgggaagataaggttggttttgttctggatctccttctccaaggccaagtcacaaaagctaactggacaaataaaatctaagtgtccaaaaaagtgcagtaagtaaatgtgagatcaaactgcatttgtatatgggagcaactgcaacaattgtgtctacataaaatctatatacttactgcttcacacagcaaatatgcccctgaatggttgtgattcaagcatatgtttaacaatcagatcagacaggagtttgactagatgaactttaagctaaaatgaacaagtgtttcctaaatccaaggtagaataatgaacacgatctaataattaagcgtgtggggctgtgactggggcagggtgaagcccgagacacaattgtgcattccccaaagtcttactacagaagactataagcaaatattcagagaaaataaatgaaaaatatagcaaaatattaacagtgattatctctgagtggtggggtactagatgatttttatttactttttagaagctttcttgattttccacattctctgaaattagcatgcattcctttattttattacattgaattttagtttaagtagaggaatgctgagagaactgactattaatagtgaataccttggcaaagcatctggtaaaacaaataaccaccatctgcatatttgttttggtaattgagtctctcatttaccagttttgcttaaaggtagtctcatccatgtggttttgttcactgtagaatcctcagtggttagcacaatgttaaacacatagcacatagggagcaggtatcagtttacgttttaaagaaataaatgaattttaaaatttggaaaacattaattgagtctctctgcttataaatatgatttgcaaattttatggatttgtgaaaatcaagcccttttatcgccctgcaggaacagacatcaaagccagcacataatgaaacataatggaggatggatcacctccattactgagttggcgaagggtccttccctgttaggtaggggtgtctgactaattggtagttaatagcaagagtgtcactgcttttgagtttatcatcaactcttaattctctgtagtgttagatgggaacaatgacgcagcgaattcccaaatcatttgttcggtttggaaaagaggtatgatttttccccagaaggtttgcctcctaattctttttcttttggacagtgcctttcttgggagtgttgcctacctggatgatggggaaggtaaccagaaatagactggggcagcgggaagccagcctgggattaaaatgtatcatcctttagccttagtgctgaatgtaaagttcactggtgccatttgagagggatagtaccttttctttgtacaacacttcagatctgtggagcctgtgggagaagtgagtgctttttttttttttttttttttgaggctttttttctgtctttgctttttcttttaaaaaatctcaggaagaaagttcaatggtgttggagggattatagccaacttgccttagattaggaggatttcttcccttttcctcaaatattttttttctcctcttggatgtggagaggaataaagtccattgattttagtaaagttgaaggtatctcctcttacaatggaagatttttttctttaaaaatctccaggggaaaagattcattgcttttggtggaggtgggggagcatctctctttaggtctggaggatttccattaaaaaataggttttgtggagaggacctacaagggcaacttgttttaatgaagctggggagccctccctagtaggatttttctttctttccttttctttaaaagaaacagtttattgggaaaaattagaatgggagacatctctcctggaaagattttcttttcctttccttgcttttttttttttttttttttttttttttttttttaatgaaacagtgaaggctgaaagatacataaggtccctgggatagggtgagattgggtacatacccaccaccccccccacacgcacattccccaccttgaagaagcttgagaaagagattttgtgtgtgtgtggtttttttttccttattgtgggggatggagagggtagtcatcaggaataatacgcaatgtctgcagtaaggtgttggtgcattttcctggagagaatttctttctttgatcctttaaaaaataatccctttgttaattttcttcttcctctttcccacccctccttctctgccaccttcactctatcctacctagtccttttccccttcccttcacatttctccccccatcctccttcctctctccctctcctttcctccgtctcccctttctttttccctctcctcccttctctccccctctttctttttccctctccacctctcccctttgtctctctctctggctccctcccttcctctgtctctctccctcttttttcctctccctatctcagtctctccctacctgctcctaccttcctctcctctctacctgtccggctttccccctccctcccttctcccctcctccctctcttcctctctctgtttctctccctccttctcccttctcttccttctttctccctctctccttctcccctcctccctcccttcctctctctgtttctctctctccttctcccttctcttccttctttctccctctctccttctctttgtttcttttttgttttcagaaaaatattcaaggactttggtgagtttgggggcatcttcattccttaagaaaaatatttctctttaaaatatactgttcatgttcttcccttcccgccccccataattctaaatgtatttgcttgttttgagaaaaaaaggggctttgttgaggctgagaatacttttgtttaagaggactttcttggctttgtgtttctcccctacctatcttttctatttgttctcaaattacaaaaattctatattaagaataaatcttttggtaaattatataaatatattaaattatcacatgttccctgaaaatatgtacatctattatgcatcagttaaaaattaattaaaaataaataaataaaataaaaagaataaagtttttgagtgaatttgagtcaactcccattagaaggattttctttcattttttcttcttttaaaaaaatcggtttttttttttttggttgtgttttgacaggaaaattaatgggtctttgtgacattgaagtacttcttctctttaagaggattctgtttttgtttcattagtaatatcctcttcaccaacacatatacccttccattcttaattttattttaaatcttaaaaaaaattgtattttaagaataaggtttatgctctttagtcatggaggagtggtatttcttttgtccctccctcccgcaccccccgcgcccctgcttcttggaattaaaaattctggagatttggtatagtcagggacctatcctttaatatttctttctttttttaattaaaatgtgtgtatctagaggggaggattcgtaaatttcattaacttttatgatttttgagaatatctgcccttaaaaagatttcctttttttgtttgttttccttaatttctttttttttaattgaaggggtggcaaataaaggttattatccttggcgaggttgaagatcctttaagaggatctccctttcttttagttccttttttcaattttgtttgttttttgtttttgggagaataataggtctcttatcttgtggttagagggatggtatctttctttgaactatttttaaaaattgagatgtaatttacataccataaaattcatcatcttaacatacacaattttgtgggttttattgtatccacagtgttgtgcacccatcaccattctctgattttagaacattttaatcaccctcaaaagaaaccctgtactctttagccatcatccccttttccacctcccatattgcttccctcatttcctttccatctctaaggatttgcctcctctgcacattttatgtaatcgggaaaataatgtcaggaagctttgatgaggttgggggaccttccctttatttttgcccccttaattttctcaagagattaagcatgagccatgaagtcaaataaagtttacaaatttcatgaatattttaaggttagaaatactgtttaacttaagatgatttctcttttttcatcttaaaatttttctttgggggatataagttccatgggctttgatgagggtgaggataacttccttttagaagctgtttctttttttttcttaaaataattttcagaggagagataaatttcattatctggggtcactgtccctttcttttcgtttttaaaattcataaatttgtttttattattttgagaatgagctctatttgctttggtgagggtggggcatctccctttagaatggctgcttgcttgcttttttttttttcctttaaaattattttttttccactgaaagaattacagtgggtgggctttggaaaggtcgggcaccctatccttagcaggatttcaatttatttcctttacaaaacacacacgcaccaacaaaaaaggtctttgtgagtaatcggttcagggtctctgcctcttctcgtttcttctctggctcctcttctatgctggccccctctgggagcatcagaagtggagcagcaaccaccgctttggaaaaaaattcagagctgatgaaatgtcagctaaaagactgttcttagacaaatgaggatcctatgtatcacaaaaggccatatgtcagatttttaaaaaaatctacaatagaaaattcaatcattacatcctataagctgtcaagttttatttttgccctcccccacctgctgccttgttcaaggaaataaaagggttaataatgcagaggcaagcactctgtaaactgtaaagtgccacaggagcagaaggaactatataatccttattagaatacccctgaatggtttcctggtttctatggatatttttttctttttcttttttcttttttttttttttttttttttttgcctttccttggaggcactttccctttgggctgcagatctgcagaagccctagtcggagattttaataagtgcataagaattgtactctgagaaactaaagaccactgaccaatacttcattatcttttctagaacaccctgtagtgactgcttaggaactattagaatacaccaaataaatcagatggtatcatcaaagcttggcaaggaggggggaaaaactgaagagaaaagaaagtaatttcattctgaccttcaacaggttaaacatctgaatctataatcccaaatctgtttacagtcactgcagatactctgttcacttaggaaaaaaatttattatcccctgaagctaacaatatcattattagtctgctgctgctgggactgcatgggataaggacactttccaagccattaataaaaattgttagtaatttgcttcttaattatagttccaataaccactctgaaaatggaaagattgactgtatttccttaagggctatatattccatgccatttaaataagtatttacttctcactctgaaaccaatgagaacaaatttttattcattcacagcagcagcctctacattgctggaaatggatagttttcaagcttcagcaagtgtttattaagcaaaatcaaggagggctgcattgaactaggcactgagaaaggccacccctatttttgagaagctcagaaatcactaataaaatattgataggaatcaccagatatcatataaacaaatgcttgctattttgcaagaaaatgtacaaaaatatcagttttgtgcataaaagctgtcctgatatggtttgaggataatggttattactgtgcagtcatcaggagggatacacagaccccttttatctcccccaaaagccatgaaagtgtatctcccctcagattttcatcaatcatttgtatgatgtgattttcatttcatagctggtcaaaacccaatgaataaacaaaattttgtctttcttcaagcacagctgatgagagagaaagaaacatggtctacttcatataagccccatccctcccccaagagagttatagcattgctaaagaaccaattcacacatccttacttacacttgctgccaccaggtgggagaccatggctcatttcctgggaattgaaacattttagaaaggaaagaaatagacatgtttggttcacagactgactgtgttatcctggtagctatttgaaaagaaaacatgagcccccttttctcagtcaattgcaggttctgaaactttcctgaaattccaaaaaagagcagactacaaggctgaaagatgttggttttttgctacaataccagtcaacaaaattatctgggagaaacttgcagtcatattcaaacacttggttttgctcatttcatcctttgaattatcaggatagtttcatgcttgctatggaggatttcattgcatgatgagacctgtattttgttttgttccctgacattttgggcacatatgtatagtatgtgtgtgtgttaggggtgtgtgcacgcctgtgcgtgttgcacagttttttccccccaagcttgcctcgaggaggcagtgtttgaaaacaacatcaccccagctaagatgacaacctgtttgccttgaatgttaagatacaagccagctggttgcaggtgccatttgtctgaggaagatgcaggagagaatgatcctatcactgaagatcagatgttcccagctgcaccagagagcaattgcatagcaacattgagggtgttgtaaaagggtttggctccaagcaatttaatttgagcacgtacctagatcctttacatccttcaaaattctccagagccactgattagttaatctgcatggccttcttaacggatggtcgtggttcttaaccccattctacagataagtgattcaacaaatgtctggctctactaagggcaaagtcaaacccctgggatcctggtctcctgccagtgttgccagatgtctgtgggtcagctagccagcacgtctgagtgggcactacgtagaggaaactaatctgattccccttaccttaatcttcctcatctgtctggcaatgacattttcctgtcaaacaggtaggagatgctttcgcatgggagcaggggatgcttttcactgggggaagggtcctggtcgccagtcagcctttcagaggccaaaggggagatgcattctctgggtattacgtccccacgtgtcagtttcacagccatgttcccaaaatttcgcttaagatggccacaggtcaggtgattcctgcttgtctctttcccaccagcttaatgcaaactcttccaaaaagacaagatcaatcacccggtgagggtgagctcccaaatctagccaccccaactttgcccttcttaagatcactgcaggaaagggtattttcaggaaggggagggatacatcccctggtgagagctagggtgttgaatttttaaaaacttatcagagtctcccaccgtcatgttttatttatttttaaacctctgcactttcttttctctgtgaaacttttcattttagccttctttttcagttattcgtcattgcagatattttgcaaactcaagcctccctactaagaactcaggaagcaaccaatgcttccatttcgtgatgccaatctgccccctcccctcccgcattctacattctataagtgtgcggtccacagcagaagggttcctgagccgtgtccttatggtctgctaggcagcaggatggaccggtattgttcgtgtgttgtgttattcgtttgtgtgtgtgtgtgtgtgtgtgtgaatgcgcgcgcgtgtgtatgtcttcctgcaggggaagctaaattgaggtgtgtgtgtgcattatcctggttttcagttttgtggaacgaagtttagggtaaaggaagagtagggagagtgcagagaaagcaggaaagacaggcatactcccgcttaagagcagacggggtttcagggtccaaggtaaacacgaaaacctttttcctccctactccccttgggcgagtgccagaagattctccactcatcttttcccggctaagtgtaacgatttagaaggcgtcgcggtagactggtagagatgaaggttccccttcacacgttctgcaatcccaactcctattttcgtgtctctaaaccaggactcctgtaccattccaattggccctggtgcgggatgccagttgccccgtttgtgacgctgcgcaacattgtatcactgcgtttgcacctacctgctgggaaatcctgcagacagatggaatggtggcttcgacacacgcatgctctccccctcctcccggagaaccctgcccttcccctgcagtgcgcgtgggcgccgcccatcccctcgtcctcaccaggagtaccagctcgaagcagccggcagaggcgccgggcacctccctggagggccgccagttgcgcccagctgaggcgccccctccccagtggcagggagggggccaagcaggcgaaggctccgcagcttgggcctctgcggcagtgaccgcggctaagaggtgtgtcccaccgcccccactcaatccgtccgctatgtattcggggccagccccaaacacttctccaggtctcttgcgctccccgagggtatcttcctcctctctttcaagatattggcgctcaccgcactgtcgcttctcttcaaggggaaaactgctccgattcccaccccctgctgtcacccccgtttctagccccaaacagcccattctcgattcccacatgttgcttcccgcctcccaaccccttcccattcccccgggttccccatccctgcatctttctcagcatcttggccagccagtgccagacaagcgggatgcaaggggtacccggagtcccgcgggctccatagccatctgacttcgccttgcttcttttccccgcttcagggggtcttttgcttacctttattctggaccacgacattggcgttctgggcgatggcgatggcgatggcgatggcgaggtctttagacctctctctcgagtgtccaccggacattgcaatagacatggtgctggacttggacggaactctggagccgcctcagggcagaactctggggccagctctgtcacaggttctggggtcggctctggggccagctctggggcaacttctggagtcagctctggggccggctctgggaccgactctagggcaggttctggagtcggctctggggcagactctgtggcaggttctggggccggttctggggccggctctgtggcaggttctggggccggctctgtggcaggttctggggccggttctgaggccggctctgtggctggttctggggtcggttctgtgtacagttctgtggctgattctgaggtcgcctctggacagggacctggagcaagctctggacagggctctggtatgggttctggcgaagcctcggagagcagcggcggagccggcggcggagccggtggtggtggcggcggcggccaaggcggcggaggctctggagactcagcgggctgctctccatcctgaggcggggcagtgccctgggctgcggcagctccgcggtccatggccgcacaccgcttcaggtctgggcagcctgagtccctaagcc

SEQ ID NO: 2258 - DNA, 222401 bp, Homo sapiens
tttgatgctattgtaaatggaactgttttctttctttctttctttctttcttttctttctttctttctttctttctttctttctttctttttgagacaaagtctcactctgttgcccaggatggagtgcagtggtgtggtctcagctcactgcaatctctgccttccaggttcaagcaattctcctgcctcagcctcccgagtagctgggactactggtgcgtgccaccacacctggctaattttttgtatttttagtagagatagggtttcaccgtgttagccaggatggtcttgatctcctgacctcgtgatccacctgcctcggcctcccaaagtgctgggatttcaggcgtgagccaccatgcccggccggaactgttttcttaataacattttcggattgttcatttgatcttgtgttttaaccttgtatcctgcaactttcctaaattcatccaggcaggtagttgtgagcaacacgagaagagcaagaatatgcctgggataaggaaaaaatgaattgagtagatcaggactataataatggttaccatgtactgaatatgttttcaacaagtcagtacttcccatgctgtaatatgttcatgaatctcctggaaatctagttaaaattcagactgctatcactgggtttggggtgggcctgggattctgcctaataacttcttggattgttagtggcttttatttattattttcaagttacaataactgcaagcaagataatactgttcccattttacagataagaaaatgacctcagaagttgagctagtagcccaggttcattgaataagtggcagaaccaggatttgaacacagttcattctaatgccaaagctggactctttctactctaccacaatggatatcttgagtagaaggaggatagttggaatgtgaacagaatatggatcacgaaaaaagaaagcttttcaatgtcagagttgcttcctggaatacatttgagtctaatctttgaggttgccttggagagcagatcaccaaggcccttgctttccagggagctgagcatgaaggtgtgagattggactatcagctagaagtaagatgaaaatactagacagaattcaagattggaagaagtctagaaagaatggcttaccttcgatcaggctagactccagaactagactctgtatactgcttaggtctatacctgagattacacctattgttgactttttctgcattctaaacatggggttagactggatgtgatgttgccactgagtaaccagagaggaagaaatatatcagtgagctaaagggcagggctgtgatcctgagatccttctgagtagaaaaataccatgcttcaatactgtgataacaacagaaataaccaatggcttaaactctgtaccccctactcaggatggtcttgaaatagatgtctaaaagctgttcccctaaaaaggctatggcagatcctgctatttaactggggatgatgaatggtatagcatcaataccatccctcagaggccagggtaagggtttagggatgtgggtaagggtctggtcatatgtttatctgtgaaggactatggataggtgaccaaattcctttccagtacttttcagcagaatctttagacttccatcacctgagttaaaacacatgagatttttttttgtccttagcaccttttattgaaatatgacccttgatgacaatctggcaggcatatctatgtcagccaagaagggagtggtggaggacacaaatgcagaaacaacaagatttggaaaaagaatagcttcacatgggatagatgacccccaacagctgtacaaccaacactggttcttcatctatagaaactgtcccctgccccacccccccaaaaagatctactaatcttcaaataatataatatgctgttgcagaaatattattggcatagacgactcctctggcaaagctccaaatgggtggaagtggccagaaatgggcccagcttcctccatctggggcttgctactggcagagcagcactgtcagggagggtcgggttcaggatgtggctctggtgtgcctgggcagctttatggcacatgaggttaaatggaaaacagaacctgaacctaaccttgaaggaggctttttatcttttcacctctccttttctttgcttccaatttcttcctttctagggctttattttcagtgtctctgtcttattctgtcagattctacttgggcatttacagctatatcctggttgagtctccagctgtgggactcaggaagattcaattatccagagccctgggaggtggcaggaggggttggggggacatgtgatagtaactcatgcactgacttctctatcagccatcatgcttgcctattacccatgggggcctgtataagtatttgacgggagacagcagaagttaagactgataactgtctttggggatctcccttggcctgccttccaaactgctactcactggcaggccttggaggagggctgagcccaggaactgagaacaggggagagagactgcatctcaagtaatactggcagtgttgcagcaccgtcacacacaatgagactgccctggcaggagtgtggcacgccagtgtctgtttagcagttcacctttatctaccaagcttcactgctagatatacttttggggttattttttaaatgctttggcaactttccctccatgtgaaaatgagcatccttgtgttctgattctaactctagaaactaatttgagatgggattaagaacaaaaataacagagttaatagtatttttggtgtcataaacttaaggtacaaccaatcacatgctgactagaaaaactcaagactatggccatagtgtccaggtaagtgaccgttcttttccctaggcccatattcccaaaaaggtgctctagcccacaaattctgagaatgatgaaacatatcagcctcatcctcccaatacaggacatctcaatttgctcattgtttgtcctagagcctgctcagaagaaaagatgacaactatggcctccattgaaagcactcccctaccttctcaatcttggctggcttgtgtaagcctagcccctgcaagccaccagccttcctgaataaagtagaatcttccactggaggggagaatggcagggttgccattctaacagtgtttctggcagcagtactaagagcaaacccagagctccacagaaaggcttaccccaccccctaccccaggacaccctgctggccaagattctcccattgttttcaaatacaatgaagaggaaatggaagctagtgacaagtatttgtaacagcagcaaaagttccttggcaaattctttggttgaatgagacatccctgctgctacagttgaccttcaaggaccctgaggaactcagcagtaactagaagagatgccaggccttggctgggttgtgtgataccaaggattggccccagttagtgaggaacagggagctaagctggataacagggcagcatttggccataacccccttcttgccatcgtccacctgagggctgcttttccagcatagaaactagctactggtgtcagggccttggcaacagcagcagttttagttgtttgtatgcctaagatcctggctgggtcttcaattgctctggggagctggctctggctggagctcccagctaccttgagttttggttcccttgagccaggccacaggctgagaaagcaatggttagaggagttccttctgagctcacctctactgatcccatagcttggagatggtagagaaatgactgaacctttctccatttcaggagatttctttggtttcaaaaagaaatcagtaagaaaaacttaaaccctgctggggaatgctaaactcaagtcacttagactttaagggaagcacaaggccaggccacagtagggaggctctgagttcaaggggaaaactccttcctagacatcggtagctatggtgggaacaattcaacgccttggcacttgcttacctagccacggtggattcaggctgatctgcagaaaatgctttccttctgggctaacttttccctctccaacttccctcttctcgccttattagttaaaaaagaaaaaaataatcaaaacataaaaataaataaaatcaaaaggccatttaaaatataacaataagaaccccctcccccaataatgaaacctacatctagaagtcagttttagtagagctattaatggcccatatggtgaagccctggggtaggcacctgcggtaacccccagcaatgtaaaggaaagatgaaacaagaggtggtaggaccaaagtcttaggacaggaagagggtcacactagccagggctaagagtaggcctcttcccctgaacttgctgctgggaaaggtaagggtagagcctatttaaacctggttccttcctaaggggcacctgggggtactcaacctttgcttgcatttttttcagtgtaattcctccctctgtgctttcccctgcaaagcttgggtgaggccctgaaactggtgccaggtgaatgccctcaaggcagccagctctctgtgagaaatggctggccacaagccctggggcagagtagagctgcaaggcagattccctctgagcctttagaggctgttgatgatatgggtgggtgatgagtacttgatgtctttggtgtcctagtacaaagcagaatgaaggcacttccttggttctctgtgcagcaagtacttgcccttggcaactgtgggaaggagagtgtggttctaagatcacaccttgctgcagctcccttgggtagaagcttgtggcttccccagggtctcctagctggttaggaccactgctagggaaggggtagtgagagacatccagggtagagggctggaacaaactgctaattgctatctacttgctgagaaactgctaacaaagaagattgaaagcacttcccacatggctgggcagggatgctgtggcagagtgctggtagaattagaaattgctgggccccaggagtagactctccctgagacatttgagttgctcttccccgagcttgatcttctcctccagctctcgctgttcaatgatgagagcagatttcatcttgacaaagtgctggtaatcttggagctggtcctgaggcaggtagcgggagaccatgccaaacaccaacttctcccggcggtccacgtgctccttcagctccttggcatctgccaactgccccgtcagctgctgcttcttctctatcagtaccaactggggaagcagaggaccaagtaagggctctctcaattaccaggcatctgtccaacagtgctgcctagcagtactccaccagagatgctgccacaaagcagctatacattctgctaattagtcagtcctagattttctgccctgaagtctacctccatgcaaaagcctttgtttcctgtagcaggagggtaaacatgacaacaattctggataggggatgtgaaattacctctttccatctctttaacgctgtcttcaatgtagggaccaccactgggcttggggtggaggaaggctctgacaaagccagcctgtgtccctttcacctggtgaacaactgtcactgtggaggtgctttctgtatgatgtgtgtgtctgtgtgagtggatatgtgtgagtgtatgtgtctgtgtatgtatgtatatgtatgtagatatgtgcctcttgttgtggattcaaaggtatatccaaagccacctgtatagggaaaggtgatgcaattttggttcaggagtatatgcatagtgacccaacctgtgaaactgacagctttccaatctcaaatacttgatgagacctccccctccaactctagagtgaggcaaaactgctgctgctactactactactgggagctagcattgattcagtgtttaccctgtcccaggccctgttttatgtaattaacataaactaatttaattctcacaataatcccataaggcaggtagtatgctcacctcattttacaggtgaagagattgaggcagagtgacgttatgtaagttgtccacagtcacacagctaataaatggtagggcaagaatttcagggcacttaaaagccagtgttcacactcttatttttttattttattattattattttttttgagacagggtcttgctctgtcacccaggctggagtgcagtggcacaatctttgctcacggcagtctccgcctcccaagctcaagcaaaccttccacctcagcctccggagtagctgggattataggcatgcgccaccctgccagactaatttttgtatttttagtagagatggggattcactaagttgcccaggttggtctcaaactcctggactgaagcaatctgcccgctttggcctcccaaagtactgggattacagacatgagccaccgtgcccatcctcagtgctcacatgcttttaatcccatgctctactgtttcctatagtagcccaacttgaaagagggagccctgagaagaaacaaatggtatttccctctacccacaccccacagaccccaactctaccttctcctggttggcctctgaatcgatgctgttcagagcattctccacccgggccagtcgtccagagagtgacagcaacaggttgaccactttgtccaggtccccaacaaacaagtggtacttttcaaattcattggatttgcagacggcttttaagttggcctccacctcctccccaagggcagaattggcattgatgtcctctagcagccctcgctgggcctcccgcaagacagaaagttttctgctgatgctttcgataagctgtatctaggggaattaaacaggagaagacaaaggatgagaatggggatcaacagaaactgatttgtgcctgtaacctctgttttggaatccaaggaacagatggtgggctctatcctagtcactggaaacaaaggaaacttgggcaagtcatgagcaactccagtcttttgggcaagcaccttctatccgtctggtagggatctccatgtcaccaccaaactttttggcattgggtaagtggtatccatgcactaaacttcatttaccagatgcaacttaataaatacttgctggcactttgttttttttttgagatggagtctcactctgttgcccaggctggagtgcagtggcacgatctcagctcactgcaacctccgcctctcaggttcaagcgagtcttgcgtctcggcctcctaagtagctgaggttacaggtgcatgtcatggatgccaggctaattttgtgtgtgtgtttgtgtgtgtgtgtgtgtgtgtgtgtgtacttttagtagagatggggtttcatgatgttggccaggctgacctcaagtgatcagcccccctcagccttccaaaatgctgggatcacaggtgtgagcctctgcacccagtcccttcctgggacgatttaataaataggagctacagtccttttgagagcctaggttggaaaagcatttgcactaaggtatttgcctatcacttcattcattctccttcaatccatttaagtacctctcaagttcatgacactatgctagatctttgcttccttagcttggcttttgaggccttttggataagactgtgagttctggagttataacgactgggtttgatttatagctttgccacttcgtagctgtgggaccttgggtgacttgacattattgagcttcactttctttatctgtagaatggggataattgctttacccactgcattgagtcataataaggagtcaatgagattatgcatgcaaagtgtttggcccatagtaagtgctgcgtaaaagctaggctgctattatttgttactcagtctggccccaccttgccattctaatgtccctcctcagagcctttcagaattagctcctcattctcctctgtgttcacaacactcattcttgtgttcctgagtagcttatgcagttccacctactctttatctctttcttcattttgattattcctaaatttcttcaggggacagctctgcccctcccctccctcacaggaagccctcctctgtaagtcttctctcagtgatctttttttgtccgagcttttaagtattttagaattagaaccctatagtgtaacttgaagttcctcactttctattccttgtgtgtgtctgatctctcacctgctaatgattgtaagtttcttaagggaagtgctgtctgtgtcttctgatttgtctcccctataggtgagtacagtcacagggaagtacagcaaagttttagagtcggagacatctggattccaattccacctccaaactctatggccttaggatagatacctaatcccacttctgtttcctcatctgtaaagtggacacctccccaactccagagattttctgatgggtaaatgaaaccacataagtaaaagacttagtattatgactggcacttaaatgctcaatgcatgcttactaatgttattattattattaaattagttctacaacatactccaaactaatagatacttgtctagctgcaaggttatgacaagaatggccctgtcccaggctgcccatagcctctgtagacagtactgctttgtggttaagagcacagagactccagtgccagactaccagagtttgaactcctgctctgctggaaagtagtggtattatatacgaccttgagcaaattactcaacctctctgcacgtcaatttccacatctaaaaaataagataacaataggacctacctcatagagttgttatgagaattaaataagttaacacatgttacatgtttagaatagtatcttgttcataggagtatgcttcagtgtatgttttaatcttattctagcccaagcactgggcccataggtttgtagttttctggaatgtattcccctctagtaatttaattagagatgtccaaagtgaccaagactaagaaagcctcctccaggttccaagacctgttgtcatattttagaactcttcaaaagtcaggagatcaccatgatctcagtctgaagtataataggtttgcatttggggaaagttccaaaacccactgagaactggggatcagtgatatgaataaggcaacacaattagatgaagaggctgtcagttatattcccaccatctgctctcccaaataaaagtcaatgctggggacaaaggatggctaggggccatctagaaaatgacccacttggaaaatcaccttcttaccccagttcccaagctccagggatagatggaaggataaaagtggagagagccctttacttcttggaacttgggctctacaacctgaacctcagtcctggggaagtgtgatggatagagttgtggagtcatcacagatccagccagagctgagttgctttttctgggacatcgcaaattggtgacattcctcacctttcttcctcagagacaaaaactgtcatagcccacccacaatcactttagttcactttctgtcgttctgtgctctgccatttctgatcatctctctcttttcctggtcagacttctaggtttgcccctgcagaggccaggccctgagtaagctaggagtacccctgctcggggaacatggaatccaaggaagcagacatctgcatcagtaaaacttcaacaccaccatgcttccaattcttcccctgacattttgcttcagataggaaattggaggaaggactcttgcaaatggccctgtaacttcctacgggtcatatcctgaaagaaatatgggcagaacaatttacattgagtttagatgtccacaaagaaggtaaattgagcctttgaggttgccatgacaaccctatttgcttatgaaatacaataggtaagtgcagggaggggaaagtgattccaagaattggattagaaaaccagactagtggtacttagacaaagaaaggaaagctttggaacgacaacaacatcatcatctccacttaactattttgtacttttaagacataattgactatccttgcaaataaatactaaagtttgccagcctataagttgtccttattttacttagtctcttctgtctcccacaaagttgcacaaagaataaaaatcaatggcactgccattggttagaggagcccactggcagaaactctgatgtgccctgggtagtgagttacttacaaggctggcttaattcagagagacagcatgtactgtacagtagaaattcagacagtcttgacttcaagtgctggatctaccatttagtctgtaatccctgggcaaattcgtcccttcaactagtaaaaaagggatagtaatatctgccttgttgggctgttcttttcttttcttcttttttttttttttgagactgagtttcactcttggttgcccaggctggagtgcagtggcgcgatctcggctcactgcaacctccgcctcccgggttcaagcaattctcctgtctcagcctcccgagcagctgagattacaggtgcccaccaccacgcctggctaatttttgtatttttagtagagacggggtttcaccatgttggccaggctgttctcaaactcctgacctcaggtgatccacccaccttggcctcccaaagtgctgggattacaggcgggagccaccgtgcccagcccttgttgggttgttctaaggatcacagagacaataatgatgattatgattgttattattattattgactggatcaaaaatagacaggacttggatctgtgagaaatccagagaggctgtatggtttccatactgaaaatatgggaatgcgagatgttctagagagtgtagaaggctggtcatcctccagatacattcaagctaaattctgaaaatctctaggacacatcaaaaaactttacctttttttgagccagttcatggtcaacttcctcctctcctaggccaatctctgccatctcaggttggtctttcagtttgttcagcagctctgccttggccacagaaatattgtaataagctgagtaagaggtagggattcctggggcccctgaaggaggcgaaaagtgctgaaactcttgtctgtggaaacaaagaatgaccatttgagcacctctgttgagaggctgctgacatttctgcttcttaatttctccatctgaaaaatggaaccctgcttcaccaaggagttgaaaaaaatggagaaggcactgttcaaatgtaaacaggccacatgaaggcaaactggagttaagtaaaggtaagttttaagaacttagaaggctatttccatgcccctgacttcatcggctagggagacttctttcgagataatttggtttggtcattaacactcaattaaaatccagaaaacctggcaggccttctgatcatcatccctttggtgcatgaccccagtatgtggatcccaaagtaggggctaggtggtagagaagtatctgagaccttatctattggttctccaagcctgttggcctccctcagacctacccctggatctcaacccatcctggctctatctagtcttcttgcttacaaaggcaccctgtggctttcctggacactctcatcatttttttcttttccaatgccactcctacttgaaatggaccctctgctgcagatctcccacagcaaagaggtcacccatgacctcaacagtggtcaccatgttggaggctgcagttagcaccctgccagggacttgtcaccgcccaccacatctctcatgaactcttcagacattgcctgctgtagggcaggacttcagcctgaaaagggatagcatctctccacttctggcatattcccaatggctcctgcctcctccatggttgtagaatgaaatggggaaaaaaatggaaccagtggcacccaggggcttgacaagtatagcaacagaccctgttgtcttgggttcaccaaagcctgtggggctgaggcattgcttctcagagccccagcccatgaaatagaacttctcaggaaaaaaagtagttctggttccatgctggcttgggtttggcctcttctgccatcaaagcttccagtctggtgtgaggaaggaagtagagagaaatgctacaatgttaggtctcagcgatggaggggcaaataattttgcccgtggtttatgctagggggtggcccgccctcactatattctcattgcctgctagccactcccatcctccacctgtctgtgtcactaccccttcgctaacctctagctgtttgaaagggaaaataggagaaactcattagtcatttttgcagctatttgcagttcttaaaggtcaaaaataatggttaaaaggctccacagctatttactgattcatgctatgctgtctcctaattcatcacacaaaagaaagttgggcccgccaatattttttatcctaggtaaattcatttatatgtaagtttcaagcttgtaacactgataaaagaacaatactagctaacatgcacaccatacttaccatgccccagaaaccatcctaagatagatacatgcacacataggtatatacatatataattgaatgctcatgaaaaccattatacagataaggaacatgaggcaacatgaggtacagtgacttcctcaaggtcaccagacattaaatgacagacctgcaatttgcacctggacaacctgactctagaatctgtgcttcaagccgctatgctatactgccaaagggacaacttgagatcatataaaagcctacatgtaaggaattttctggctggagtatatctatgttagcagataatggagaatattctggagggaatatgaaggtctgaacttagggaattcctatctacaagaaaaatatttagggtatgtgtgaaagttctgtgtcagaaggtgttataaaggaaaaaaaggatgtgctaattggagactcagttccccagcatacacatccctgcatcatattatagtatatcacattaggcactatattctagggatcctttccttatcacctccattaatagggaagtgattataggtggtctatgtagtaaacatcaaagcaaaaagcagattcctttcacagagcactgagaggaaatgcatagagtccataaagcaagctatacctatacctgaatcagttattagacttaaataatacttaattattccactagctggcttctgtgtgtatcccagcattttttaacagaacagtatgtaggttataaaggtactagagtttaacttggctgaaattaggatatctttgtttgcattttagattcaaaatattatgcatctatatgtcccttacaaaatcttaaagctgcttccttctggctaggacactgtcctctcctagggtctggaatagaatcttcttcaagagcccagagatcgtgggatgatatagcaagcatagtgagctacctgagatcttgtgataaagttactttatctccctgggccttgcttttttcatctaagaaatggagaagatgaatggtaactatttcataggtttattttcatgattaaatcaatcattacccaaagtgcttagaacaatgcagggcacatagtaagcaatcaaaaaaattagctattttgggaatgatgctgttccttaaatctccatcactcaaaggagcatctaattgattttgtagtcacaagcagagctgtgtgcaaacaaatgttttcccttacatcctagagtcattaaaaataaatctctggagcaagttacaagatctctagtaatagtgatttctttctgtctggccaaggtgccaaggcaaagggagctacacaaagaaggaagaaccagggcttgtaactgctgcctctggtacaccttgccctacaggagagaagaggaccctgtgactcctggcctatggaaagaacaagatctctctgggagaggctgcctaggaaggcaaaataagcatgggctttggagtcagacagctctggctttgaatgtttgctgtgtaacttggaattagttagtttcctcatctgtcaaatggggataataatggctaatagggctattgggaggattaaatgaaatagatacataatgtctggcagtgtctggtatataagaaatacttaataaatgttcatccattcatttatttgttctttcttcttaaatatttgttaagtgcctactattgggaggtcattttcccttttccctgctatgatagataacaatcacaggtatttttcacaaaatgttttctaattacaatgagaatgctccccaggtagaagaacagcttgagaagcagccacatgggatctaatgaaggattcttttttttttttttaattatactttaaattttagggtacatgtgcacattgtgcaggttagttacatatgtatacatgtgccatgctggtgcgctgcacccactaactcatcatctagcattaggtatgtctcccaatgctatccctcccccctccccccctcatgaaggattcttaacagtgcctgggagccaggccctgtaaatgctgtgcttatggcatcttgggctggaaaactgatcaactagctccacatagacaagtcacagatttgtctgacaataaaagacatgataacaaggtacttctaaccgcaacaagtctcaggcaaattcctgctataaagagagttaaggaaagcacttataagccacctgcctcccgaacctcagccccagcagagagtgggctgagctctccacaggagagcaggtggagctgctgacagccagagcactgagcaataatagcaatgatggtcctggggcttttgctttggagcaaaagaaattaaaaaaaaaaacccaaccatgcactatagggcatgcagatgacaactggctcagtggagtgaacaaacactggcagtcctgctgccagaacacactcttgctttggcctccctgcccaggcagctcaccctgtcaactaccacctattacacacccacatgaatgcaaagaggcaggtaaacaaggagggggagaaagtggaagagaaaaagaatgtccttatctattgtaaggaattatcaaggcatgaagcacccagccccaggaatacctttgatgctggtggttgtggggggacgagtttagaagcccaggctacttgtcctagagcagaggcaggtcaggttgtgagctggcctcttattctggagggcaagcagaagagaaggcaggaaaagtgcctgagccaggtttctgggaaagacctagtataggcaacaagtgttcaatgcctttgggatcaggggccagaaattgatggataccatgaagacacactaaggaaaagtatagtactttaataaagatatttagggataagaacatgatatttactgagcatgtactatgtgctaagcatggagctatatcctttatgtagattatcttaatattcataacaatcatgtgaagcaagtatcattatacccattttccaggtaagaaaactgaggctgggagcagtttaactggccagcctgaggtcatccagttagtaaatagtggaggtaaaattcaaacttgtgctgcctgcctcttcagagacctagtatctttcatatgtacttacttggcggattcagtggcttcctgtcccgatgtcctccaaagcccaccaatgccatagtagcaagggggctgagcctgctcaggttgagatcccaagtgaccccttattggaggcaagaaatcactggaatggagtgcaaaggattcttgctctgctgggacactttgtgaaccctgtctcgagccctccaggtggccaaagctgaggggttgtggctgctctaggacctcctcaggattgagagcacaggaaccagaggtttctgaactgaaatactggggtggcagctcctcttcctcctcctctgcctcctcctcctcctcttcctcttcctcttcttcttcttcttcctcctcctcctcctcctcctgttgcttctgctgctgctgttgctgcttctgctgctgggctgcacgaaagagcctgtacttctcccagttgggaggaggagggcgaggaggaggaaaggccttcttcctggctccgagaagatccgactgggtctcatcacctttgctaaagagctccctcctatgctgcccccaggcccgggtgctttggggcgccaagctgatgtgactctctgagaaggcacggctgcgcagtgggtggggcatggaggcaagggagctcccctcctcataaactgaagtttcctctgattttttcaaagcatgtttgaagtctccaaggaggtcaagagaagaaattgctcggtagcttgacaagtccagtgctgggttctcaaggcaaggatggaaaggggttgcccatgaaaagctagtcttggaatgagccatttccctgcaaaacatcagatgagtactgagaaaaacaagcaagttgcagataggcccatattttggatgacaacatttatataaaatttaaaatgtccacaaaacaatgtagtatgtgtagtaaatgtaataatagtaataataatattataataatgatagctaacacttactgagcacacactaaatactaggcactgtttaagtggtttccatgtcttcacttatctaatcctcacaataaccccaggaggtagctattactattgcactgattttacagttggggaaactgaggcatagagcatttaagtaacttgcctggggtcataaagctagtatgtggtagagctaggatttgaacttgaacagtttagctccaaagtctggatatacacatactaccccagtctgtttataggagtcagattgcatgtgctgttttctggggcttacaagcctggttatcctgcctcatctgttgtttttgtttgtttttcattataaaaatgttgaatatttagaaatgtacagagattgattgccataatacccatgttcctacctatcacccagacttagtaagtttgaatactttgccatttatgttttatgactgtttcttaagaaataatacccttcacataactctccacttccattcccctattgcctctctagatgcaacctgtattatgaattagatatatatactttctgtgtttttatacttgtaacaaaaaacaccacacaggtcattcatagttatctgctattttggatttaaaatatctccttctggccagacacagtggcttatgcctgtaatcccagcactttgagaggctgaggtgtgtagatcacttgtgtccaggagttcaagactagcctaggcaacatagcaagaccctgtctctaaattttttttttaattagctgtgcatgatggtgcgtgcctttagtcccagctacatgggaggctgagatgggaagacagcttgagactgggaggtcgaggctacagtgagccatcattgcaccactgtactccagctggggtgacagagtaagaccttgtctcaaaaaaaaaaatatcctaatgcaattccaatcagaattctcaataggaatttttaaactacatttaactacagaatttttagaaaattaacttgtaataaaagcaggatataatattaaagagtattctgctacagaagaaatggggaagggggtaagtaagggataaagtatattataaaataattgtaattgaaactgtgttattgatcaacaaaacagaatagaaagttcagaaacaaagcagactacctataaaaacatcatatacataatcttcccccaaaaaggagataaagaaatattatttaataaatctttttgagataactgcaaagcagtgctttttggagctacatcatatattatataccaaaataaattccagatcaagagtcatggatatgtgtgtgtgtgtgtgtgtgtgtgtgtataattttaatatattatatatgttatatgtgtatatatatgtgtatatattatgcacatatataacataagaaaaacctatcagaaaattaaaaagactatcattgtgaggtgaaataagattctcataagcaatagaagaaaacctccaaataagtccaggtttatttgaatttacataaaaattcaaacttctgtataataaacactgactaaagttaaaagacatctctttagcctcagagtataaagagttaagccctctaaaccacaagatctggtttcctgctgtagcctgtgagcaatcagcatcatgctaagtcctgcccagtgacaggaaattccaggggttcaattaaatcatcatacagaatatccattcaataatcatgatgaagattggaaatagttctttaaaaaataataatacacataataatagccaaattcagacagaatggaagacaaaatgtccttaattctcctcttatccctcccccattctggtcagctcaccactcatgtggatcagaaattcatatccagacatacccactatcttctcatttgggcctttgcacacttatagatcattaagattataacaatcccttttgtgcaaactgttccacctggcatattctctctctctctctctctcacacacacacacacacacacacacacacacagtgatggacaagtggaaagtaaaaaaatgacaaacgtgtaccaggcagagaagcctttcctgactactttatcaaaaatagagacaacttacatttaattatccttattctacttcattctttgagtattcatcttcatccccacctgatatcatatcacatatctatttttacttgattattttctgctccaatctctaactaaaatgtaagctccatgagggcaggatcttgtctgtctcattcataggtttctagtgcctggcacacagtaagtgttcaataaatatgtttaacaaaggaattaaggtcaaaattaaagaaaaaataaattatgatactcatttcatacataagttgaattaaaggcaaaatgcaataaataagacaaagaagggcactataatgttaacaactagaacacatgatggtctacctcctctgatcttttatgcaccaaaaaacatagcataaaaattcttaaagcaaaatctatagcaaatgcaaaggtagaaaaaaagtagaaacaaaatatgagactgtttcagctgatgacagatcatgacagtcaaaaactaagataatgagaaaatctaaatttcttcatatactgaaacagactgtatttttttaatcaagggcccattgagtatatttttaattggctatatactgagccagaaaatggaagtagtacagaccatattttctcatgacaatacggtaacactagtagtacagaccatattttctttttttcttttttttttttttttttttttgagacggagtctcgctctttcgcccaggccggactgcagtggcgctttcttagctcactgcaagctccgcctcccgggttcacgccattctcctgcctcagcctccccagtagctgggactacaggcgcccgctaccgcgcccggctaattttttttgtatttttagtagagacggggtttcaccgtgttagccaggatggtctcgatctcctgacctcgtgatccgcccgcctcggcctccccagaccatattttctaatgacaatacggtaacactagaaattaataacaaaatgaaaataaaaatctttagcatgtagaaaataaacgggaaaaaaattcttccactttagtcgaagagaaaatctaatttgaaattgttgaatatctagaaaatgacaacaaacaatgaaaatatcagaagctagaggatatggttgactaaagcagtagttaaagaaaaacttgtaggctgggcgtggcagctcactcctgtaatcacagcactttgggaggccgaggcgggcggatcacttgaggccaggagttccagacgaggctgtccaacatggtaaaaccctgtctctactaagaatagaaaaattagccagatgtagtggcgtgcgcttgtaatcccagctactcgggaggctgaggcaggggaattgcttgaacctaggaggcggaggctgcagtgaactgagatcgcgccaatgcactccagagctccagccaggttgacagggtgagactctgtctcaagaaaaagaaaaagaaaaacttgtagccttaaatacttatattagtatgtaagaatgaattaaaataaatgaattaagcattcaacaaaagaagaaaagaatcataaaaataaacctaaaacaaagcagaaagacaataaaactaacggcagaaattaatatactagagaacaagtgatagaataattaaaggcaaaaccaattcctgaaaagaaaataaaaaacaatgaaacagattaaccacttgctaatctaattaaaaaaaaaacacccaaatgcacaaaattagaaattgagaaataaccacagttacagagtaaatgaaaagaataagagaatactttgctctaccccataaaacaaatttgaaaacttaaagtatttttctgtgaaaacaaatattaccaaaactgatttcagaagaatgagaatatataaacccaccagttaccataggaaaaaaaagtataaatttgaccaaaaatagcacaatcacatagtcttgtgttaattctaccaaccttcaaggaaaaaaaatcaaaccaatgttatttacattttctagaatctggaaatctagagaatagagagagaagaaaagattcctgcattacattgatactaaaacccagcaaacagaacagaaaaagcaaactagagacccatctcatctgagaatacagatgcaaaaatcttaaataaaatattagcaaacagaatctaagaggatgttaagaaatatgatacaccatgatcaagtggggttcatcctagaaatgtaagactggttcagtaatagaaaatctactgatataattgacaacattaataaatcaaaggataaaaggcacataacaatttccctaatgctaaaatgtatttgataacaattcaacatcacttccagataaaaaaaaaacctaacagaaaaagatgtctatttccataataccatcattatcatcagacttttgttttaaagtcaaaagccaatattgtgcttaatggcaaaacactagaggtatacccattaaaaacaagaacaaggcaaaggtgcccactttccccactaatatttaatattgttctgaaagcaatagtgcaatttaacaaaataaagatgtaaacattggaagaaggggatatcttctcattatgtatagatgatacgattatttatctggaaaattcatcagaaactttttttttgagacagagtccagctctgtcacctaggctggagtgcatgatctccgctcactgcaacctctgcctcccaggttcaagcgacactcgtgcctcagcctcccaagtagctaggactataggcatgcaccaccatacccggctaatttttgtatttttagtagagacagggttttgccatgttgcccaggctggtctcaaactcctggccttaagcaatccacccacttcggcctcgcaaagtgctaagattacaggcatgtgccactgtgcgcagcctcatcataaacaatttaaaaataataccaacaacaggaaaattcagtaaggtgtcagggtataaaattcatatatggaaatcatcttttctacatagatgcaacaattagttagaatatataatggagggaaagatcacatttactgcagcaattataaaggtaagatgcctagaaataaacctaacaagatatatgcaggatctatacgcaaaaactttaaaactctattgagaaacataaaactagatgcacataaatgaaaggactcacaatttcctagcaacgatgactcaacattgttaagatgtcaactccaagtgaatctataaacttaatagaaactcaataaaagtgtcaacagactgcattttggaacattattgtaaatttcatatgggaaaattaaaatcgtaagaattattatgaacggtatggaaaaagagagatgaaagagggaagaccagccctaccaattattgaaataatttctaaagttagcagtaaataaggcagtctcacaaatagaaaggtagatccatggaataaaacagagaacactagaacactgaagtcaactcaaatgcataggggaagttagtttgtgatgaagcatttcaaatagtgggggaaggatgaatcattcaatacgtagttttagaactggatagccattgagacaaaaataaagctgaatcatcctatcactttttacaacgaaataaagtttagatgtatcaagactcaattgtcaaaaaaataccataaaggtactagaagaaaacatttttaaaaatataaaataatcttggcaggataagttctttttaagtaagacacaaaacataaaagtaataagggaaagtttataaatttgacttcttaaaacttaaaaaattatgtccagaaaaaacaccataaagtctaaaggtgaagatatactgggaaaaatatttgtaacatatacaactaagagtaaatatccttaatatgtgaagtatgcttaccaatcaataaaagggaccaacaactccatagggagaaaaaggtatagttcacagaaaatgacttatcaatttaccaaaaggtgttcgacctcacttaaaatttaaaaaatgcaaatccaaacaataatgacactttttaaataaaaaaagttaaagaattaatgagggtataaggaaacaggtgatcttacacactgttggtgggagttgaaattagcataactcctagggagggcaatttggaaggcaaagaaggtaaaatgtgcatatcctttgacccagtagttcaacttctagggatttatcctacagacacattccaacatgaacacaaagagatatccataaggatattcactgtagatttgtatgtaatcacaaaagactggaaaccatctaaatgtccttcaatagggactaaataaaatagggaatatctatatatggaacactatgtagcgttaaaggtgatgcaatagagctatgtgtaacatagaataatcactaaaataaaaaagcaggatgtacaatagaaaagatatgcaatatgttcccatttttgtaaaaaagaatgtatatacatgcacacacgttacttttctggaaggatacacaacaaattgccagtaatgtctcttgtaaagagttgtactgatggtttggggtgagattctcttattgtgtgtgtgtgtgtgtgtgtgtgtgtgtgtgtatacactaaatgcatttattacttttttcaattaaaaattagtaaacagaaaaataaagcataaatctgattttgttatacatttttctgcttgaagcctacattattcataaaatacagacccttactaggatttgttaggtttcttaaaattctgcctttcctatcctcccacacttctttttgcctttacatgctgtttgctctttatcttctctttccgcctctttatctgacttacttttagaattccactgagatatcatttccttgaggaagccttccctgattcccccaaagcatgggataggtgcccagactgtcctctaacagcacccattaattttcctagcacactactgcttagttgtctgccccttccacataaccatattgagggtgaaggcacatgtcaagttcaccactgtatcactagtatccagcacagtgcccggcacacagtgggtgctcagtacatatttcttcaatgtgaaataaatgcaggtttgtgtgactatggaaaagaagaaaagttagatcttttttactgtaacctcgtagcccaggttgccaggcaatgggaacaatgagtagcaggtaaagcagtcagcagctgtccaattgctccagaatctgattggggtttgtgtgtggtggggggagggggagtggcctgggatttatctcgaggctgtgtttgcatagcaagtctgttgtttttacctaaattgcgtatttatttggggtagcgcaagctaatggaaattatttgctttgctcaaccttatcaagcttcctaattctattactgggctgatttaccctacagtgctcaaagagcaccggagttcatgagctgcatggagctttgctgctttgatcaaagctggtgccttgtcaatgccgtccttagctacacatctcaaaagatgaggtgcttgtctcatgtaggtgctctcataaaatgctgcttcctacttcaactgggtgcctggccaacgcccttcagccttgtccaatcattttttcagtttttggtatccaaagattaacgattaatgggttactgatatttaccttgaaacctttatggtcagttccctttttcttcattctggaggagttctgggtttgtagaaaaataaggtcaactctccactctactgggcttttaccattcttttttccttctccctgaaactggatttcaaccacctaccctttttttttgactggtcatttattttttagtctagggtagttgtgttcacagaacttcttttatatttatttttttctatttcttgcatttcaaagcataaatatgaggacattagcacatataagaaattaataaatatattgccaacatatgttgagggtacatgcttaaaaaattctttctgagaagggtacatgatccaactttcattggaaaccactagtctgggaaaacagctcataatcaaagtggctcctcattagaattacccaggaagttgtttaaaatgcaaattcataggccccaaccctagaaattgggtttcatacctctgtggtgggatccaggaatcagcattttaagcaattcacctaaaggattctaacacaggtggttcagggaccatatcatggaaacaaaggttcagagtaaaagggttgggagtgctatggtttgggggcagttatttgttccaattaggttggtttccaaactatacattctgtcccccatccctcaccacacacacctggttgcccatttctatctcctgtccctgcctctctcccgaccttcacctccgatgtagattttatgaaatgcagcaatatcctcaaaggcaacaattgggccaatgtattgcagctgtgatgaaaacaaccctgctccatgataacaatcaaatttaccacattttcttcttccctaaccagggcacaggacaggcaattgagcaaagcagaaagaacacagtgttggaaagacttgggtctgaattccaataaaatttaaaaatctggctctataactcaaaagctgtgtgaccttgagcaaggtatttcacttacctcattttcaacaaaatacctatcttacaaataagcagtcataaggatgaactatgtaaaaaggacctagaaatgatgctaggaacatggaaaattgccttcacaattgtatgcttcaggcttgctccttgttcccatcaagagaattggactgcactccctgattaatgttcaaccctgctcaatagccaagaaaccaggagacctcaagtcccagctcaaccacatagctgactagccaggaggccctagtttactaaggagtttaagcctggactcattcactcaaacttttcctatctactaaaaagggagatataataaaaggcaagtttagggttaagagcagtgtgacaatcaaaaggtctggatattcaaaggtgtcttaagtactaactatgtgtgttagccttaaaaaaatccccccccccaccccatcccggtaataaactccagaaacagttggaagaaaagaacatgcccttctagggacatctggtgccccaagtcatggaactgtgaccctatctggaggtactgggcacaaggcaacttgggaattgctattctctgcatcagccctcattttaaaaccactgccctcccactcacttgccctgtgttggggcagcctgagacttgcagagtcacttatatcaagcaggcagaagaagaccaactccagaaggggaagggctacccttaatgggatcatctgggccaacgtgtgtactagtcattccttcaacaaatccttgctgaatattacactgtgcaagatgaccagatcaaaggggagcaaaaccaatgttgctcctgtcttcctggctttaacaattgaagcaaaatggtgatggtgaaagggaggcttccattgaagggtgtcagcctcaagccaaggatattggttggcctctagaagtcctattttcaaggggatcaggcctcctaaatgtacagaaatttgcaactctgctttgagaccaagtaaggattctttccttggagtggagggcaaggagcttcattaaggaaaaggaactactctggtttctttcttttcttctcttctcttccccttccttccttccttccttccttccttccttccttccttccttccttccttccttccttccttccttccttccttccttccttccttccttccttccttccttccttccttccttccttccttccttccttccttccttcctttcttatttttgagacagtgtcttgcccagtctagagtgcagtggcgcaatcttggccgactgcaacctctgcctcccaggttcaagtgattctcatgcctcagcctccccgtgtgccaccatgcctagctaatttttgtatttttagtagaaactggtttttgccatgttggccaggttggtctcgaactcctgacctcaagtgatctatccaccttggcctcccaaagttctgggattacaggcgtgagccaccgcacccagtcgactactctggttgccaagtgttgggccccgtgttaggcactttcacgtatgtatttccattaatcttcacaacaaccattattgtcagtttgcagatgagactcctgaggcttaaaaaggataaatcattttcccagctagtaaaaagcacagtgtccagacctgccttgtctgtctctgagagataatcgcagggaagcagggactcctggggtacagcaaaaggtacttgtgctacattcatcctcgggcgtccatgaaggctttagcgcctcactgaggaaagcagaggaagcatgaaagcaaactatgagaaagggctttgttgacatcagcaaggagactacatctcaaaaacaaaagtaaattgcctgccaaaaccagggttgttcatctcttttccgcttccatgggttgccttttcttctgaagaacggattttccctttttgttaaaatatttttttttggcctaataggaattgaaaatgaaaaccaatatttgcagagactgaaaaatctcctcctacctcttcctcggcccttttgaagtttcttgtttggaaactttatttttaagctcaccacaatagcttggcattctagaatctcagtagcaacagcacacaagcccaacccgtctcgcctttcccttccctcagcagccaagtaagactgctccaagagaaacagacactcccaggttattgccgaaggaaatatttgcaagatccaggaagtgagacgcaaggaggatacacagggaggggagaaggacccagagagcctgttgctgccacccctgcttgcccccgggcccacagaaattcaagtaatgaacaattagcttggcaacaacaaatgcaagtggcagtgcttgccctgaaccttctctagtcctcaggaggctgatgcaaagtgtcctgtgaagaaatcagagaagtccttgctttactggggctgtcctgggtgaagcttagctccttctctccaatgaccccaatctatatttgttgtcaagtaatacatacatatgcagtcactgtggtagagagaaaatgtgcttctttgtgaataatagcactgaaatgcaaactagtgctagtgatagaaatgaagggaaatggaaaagctttaagaaagggatggttctgaggcagataataaaatgtttattggtgggggtgtgtgtgagggggtactatgttgtagtggtggtgacaaatttggagattcgtagaggtctggtgatgtcaaagttcttgtggatttaagcaagcaaaagtgctagtggatggagaattctagcaaacccaattctagctagcagtgagagtaagcatgtctggtaagtaacattgtctgtcattggtacggggattttttacaaagcccttgatctttaacttctcgggtctatatcaaaccaacgtgggccacctcttattcagattttctttttaattataaattccaacaacttgacatgtacctaaagaacaccatgtacattcatatccaactatttacattttgccagattcctttctgaattttctttgtgtatggctactatcagattagattcaacatgtggtttcatatttattatttttttgttaatattacaaccactcatttctgggaaagacccaacatttgtatacctgtcactgttgatggctattctattttgttccaagatgatgatatattagattggtaaactctttccatgagtataataagcactactatgaacatctttaaataattttttccctcttaggttatttccttgggggtattttaggccaaataatatgaacacatatttctagattgtcctctaggaagactaaacccagaaacacatactcttgtcacatttttctagattgccctctaggaagactaaaccaatttgtattgtttccagaagcacgtttcctcacagccttgccaaggtagcattttacaatttctatttattgatttttttaattgctgatagtttaataagcagattatgatgccttgaagttgcttctatttgtacttctttaattgctagagaggtggtacttttccatgcaatgattttactccctttattgcctcatgtgtaaattgcctgttcattttccttgcccacttacgaagctaaatctgaaagctgaccttctacccatttttatatatatattttttggacatgcaactgttgtcagtgatgctgatcccagacattttcctcgttctgttgcttagctttttattacattttgttgtacaaaggcttcccccccaccaacttttatatatttgaatccatcgatcttgtctctgatgatatcctccatttaacagacacaaatttatcttccatccacacctggaataaatatgcgattctactggtccactttctatacagtatgtgatatgaatctaagttaattattctccatattgatatctaaaattcccaacattttttaaagaaatagtaattgctttccccagttcagggttgtttccagtgtgtcctatatacttaaaatagcttgagtctgtttctagaagctcttttttaatttcactgtttgactttttttaacccactatcatatggttttgataattgttgttttatgatacgctttaaaatctgatagggtaagtctaccatcattaacttttaaaataaatgtactctttggtatttccgcccacttacttattcttccagataaattttactataaatttgacaaattctataaagtatcccatggtgactacaattggagtacattatgtctacacattaaatttagggagaattgtaatcattactatattcagtcttcctaaattaaagcaaagtatacactatgcatttattcatattatttctcccattagagttttataattttccttgaataagtttcgtgtgcctggcgttaaattaattcctaagtatttaaattcacttagttatacttgtgacaaatccttccgagcctctgaaggctgcattcttcttaggtagtaaaggcttcctgaaaagtgtactcttcctaatgaaatcagattcaactctgaattacccatattctttcactcaatcagtaaataggaactctgtaccgggtatttcacactctgctcatgatgtggtgtgacaaagggaaggaagagaaccctaggctgagaatggaaaatcctaagtagagctctagtttggtcacttacttgctgtataatcccagtagtaatgggctctgaagtcagatgcctgtttgaccttgggcaaatgactttaatctctttgtgagtcaatttcttcatctgcaaaactgggtcaataaacagtaatgctctcacggggttattacaaataataaaatacttcatatgaaatgcttacaacagtgtctgacacagaataaacactcaataaatgttagctattatacctgttgtggctgctgttaatggtataataccttttctgagtcttggcttcctcatcagtaaaacgggaaaaataaggtttaacctcagtgttgttgtgagaattaactgtggtcatgcatataaaaacaccctacacattctaaagttctgtgcaaagtgaaaaaaatggaaagggtcacagcaggcaatcataggtacagaaaaccaagagagataatccagaaaataacttattttggcttttaaatatatcacagtaatgtagctttttctcccagtagatctactcaccatttttatccctcctgctaatattacaatttttacattctcttcacggaaaaccaaataacagtggaggaagacaactaagagtataactacctgaaattagcaattcattgcaggcttccaggcaaagagagtggcttaagaatacacatttgatttttccacctacactcatcattccagtttttacagaaataacatagtaaatgttaaaatttgtgtgtgtggtggtgggggaaggtgtgaagggaaactctatcaggatttctcctcacagatgtcatctatgccctggacatctcctagtccttctcatgtttcctgagacctttaattgggacctgcctcttccatcttcagtgtcaatacttccttttctattgagctttcctttctgttttaaacttaattcagttttctagattctgactgaagtttcatttgaactggtggttctgaaacttagcttgcgtcagaattgcctggagggcttgttaaaacagagattgctgggccacatcctcactttctgaatcagtaggtctgagtatggcctgagaatgtgcatttctaacaagttctcaggtgatactgaggttgctgggcctggggccacattttgagaaccactaaattaaacccaattgctccctctaactatcatcctatttctctctttccttttcctagctaatttactatttttaaacatcttcctttttaaacatttttttttcttttgagacagagtctcgttctgttgcccaggctggagtgcagtatcacaatcttggctcactgcaacatccgcgtcccagattcaagcgattctcctgcctcagcctcctgagtagctgggattacaggcgcctgccaccatggctggctaatttttatatttttagtagagacggggtttcaccatgttggccaagctggtctcgaactcctgacctcaagggatctgccggcttcggcctaccaaagtgttgagattacaggtgtgagccaccgcgccgggcccctttttaaacattttaaaaaccacacagtaacaattaatctttgtagtaaaattagccaaaagaaactggaactctcttttgctggtgggaatgtaaaatggtgcagtcgctttagaaaacgggcagttcctcaaaaagttaaacaataaaattaccatttggcccagcaatttcactcttaaatatgtaccaaagataattaaaaacataaatctacacagaaacttgtacatgaatgttcatagcagtaatattcacaatagccaaaaagtgaaaacaacccaacaatccattagtggaaggactagtaaacaaaatgtgatgcatccatacaatggaatattatttggaaataaaaaggaacgaagtactgatacatggatgaactgctaaacattatgctaagtgaaaggagtcaggcataaaagaccacatattgtgcgattagagtcatatgcagtgcacagaaaaggaagatctataaagacaaagtagattagtggttgcttaaggttgagagtgggaatggagagcaatggctaatgggcatgaggggtctttttagggtgatagaaatgttctaaaacttgattgtggtgattgtacatcactgtaaatttactaaaaatcattgaattgtacacttagaacaggtacttgcatttaaattgcattaaattgtacacttaaaacaggtacacttaaaagctgcttgcatttcttctctgtgctccccccttacagaccaccatgccatctattttctatgcctaccgctttactgaatttgctttcttgaaggtcacttgtaattccaaactgttaagggcattaacagtcatctgcttatcttctacactggcagatttctccttctactacttcagctgcttgacccttcagtttcctttgttgattcttcttcctcatcctgtgccctggctgggtgtttgacaagccttgaaagactcaacttgtatcttccactaacttcaaatacaacatatcccaattcaaacttagcagcatcttcaccaaaccaggtccccttctcaagtgccccatctatgccaataacattctccaagtcactggggctcagagttgttttttatctttttatctttttttttttttttttgagacagggtctcgctctgtcacccaggatggaatgcggtcatgtgatcacagctcactgccgcctcgaacacctgggcttaagtgatcctcccacctcagcctcctgagcagttaggactacaggtgtgtactatctcatgcttggctaagatatatttccttttttctcctcaagttctagtcaccaagttttctctaccttgccctcaaaaggtgtcacatatttgtgagcaaataatctgaacagataattcacatgagaagcaataaagatattaatatattaattagacacacaaaatattcaaactagaattatcaaagtaagcaaattaatactataataggtcccatcaaactgtatggcattagaaaaagaaaattttcaatggtgacataattttggaaaactggtatgctcatatattgctaatggcatgtaaaacatctcgtggggaaaacagtttggtaagatctatgaagaaccataagaatgtttgtattgtttgcactagtaatcccaactccacataattgtttttaatgagataattcaaaatgagaaaaaaagctatagtgactcaaaatatttctgctgcattactttataatagccagaaattggaaacaacctatttacccaacaatttgggaatgattaagcaaattagagcatattaagctggtgaaatattatacagccactaaaaattatgacttgaggaagcctgcatagcaacatgaaaagttgtttaccacataatgcttagagaggaaaaagaagcaggacacacaaaattacatctacatggttattataatcatgcttagaaaactctctatacctatagataaagctgacagggaaatgaaaacaaccaaggtgttaaggtggtgacaataaggtttttttttcttctatttttaatttcctgtaatattgtttttacaataaacaaactcccctcccccaaatatcacacctatttatctattccttctgctccatttctatcgcacctctacctccccaatccagggccacattctgtcatggccagatcacttctcctaattggtctctcttcaacccacttaggctgcaaacactgcaaagttgcctaaagggccacatttatcatatcacttacctgatggtaacctttcattgctcccatgtttgtgatcctatctaggtttacctaggctggtctacctaggctggtcaaggcctgcctaggctggtccagtgcttcactactcacctttcttctctgctgctgctgttcttcttcctcctcattacagataacatttcctgagagtttacggtgtcaggttttgctctaaatgctttacatatattaattcatttagtcctcataacaacaaacatttgagataggtactcttatcccattttataaataaggggggaagggaaagagagagagggagtgaggcaggcaggtaggcacttgccaaggccacatggctagtgaatagaagaatctggctttgtacccaggcagaactgactccaaggccagaacttaaccagtggggattattcctccaacacaccctgcttagtctcctctatgggcctttcctcttacagctaccaaccctcagttatttttatcctccaatgaacttaaatagtgtacagtaatagttaccacgtgctgcccccttaccaggtgccaggtgcttcttaagccctgtatttgacagggtttcatcttctgtcaacttgtgtgagaaagtaaaagctgggcttaattcctagcttatccctttactagctgtgagaccttgagtagattccttaggctctctgactgtgaccctttatgtgagttagcaattctcaaactggatcccaggaccagctgcatcagcatcacccagatgctgtttgagcctgttcgaattgcaggttttgagctccactccccacttactgaatcactctcaggatgcagggtcaggtccaactatttatctgtgtttcaattgcgcaatcaagttttgagacccaccgccccagttataatcatacctacctgacagagttgttgggaagataaagcataagataatatgtgtaattcggcttgcagcacataggttgtttggcaagtggtaatttattattattgccatttagctttgtgtgggttagtcttccctgctcaagctgtgggcaggcactgtgcttcctgctgttcttttgctcgtatttctcaccttgcccagaaaaaggcaggacctatattaggttttcaataaagtcctcttatttcactgactaatcagtaaaagaaccatttcagagaaacactgtaatgtagtatagtgtccctgaagctagaccgcctgggtctagtcaactgattagctgtgggacttcaggcaaatgaatgtatctctgtgtgcctcaatttcttctctctgtcaaatggagagactaatattaccaactccataaggtcatagtgataaatacatacttgtaaaatgatttgaatggggtctagaatagagcactgtgttcaagaaatgttagctagcattattttgtgtcatttcacccattaatggtggaggaggttccatttcttcatttggcaagcaaatgacaagtacctcttgagcaacttctctgtatcgggcaccgtactaggtacagagaataaagctatgaccaaggtatggtgtcctctctcaaggatctcagtctaatacaggaaacttgcatattccaaaatgtcctagcaatcagtttggtctgtacccagctatctaggagtgcggggggcagggggacaggctgaattatatctatggtatcaagcccttagtctagataccaggccagtttcctcaaaggaaactaagcaaaccaaagaccttagcaatttctacagaagctccagaggcaccaacccaccccaactccctgagcgctcacttacctccctgactggctggtcttcctgtttcctgttattggattccatttgtccccaggaaattcctgtaaagaaaaatcctgataagttagaaagctttgagcagccaggtatctagatggcctcaaaaatgtgaagaggtcaggagccggtgtctggcccagccccccagcttgtttcttctactctgctatgcaggctgagaaatttgtacctggagggctgcctttctgtcggcaggcttgctaaactgctgcagacatgcagagactaagggagcacttagggacctggacaccatggtctaggaatgctgtttccctctttctccactcccctcccaaaccacattaaaaaccagtttagtatgtttgctgtttgccctggctcttgcctgcacagagagatggaggtctttttgtttgttctgctgggtgaacctgctcattcctcctgcctcttccaacagagaaagcatctacttggaagccctgacccttgaggggggctttgagggcagaagctccggctgcagcaaccctctccccaggtgaggcagagggacagcaggtatgccagcatgcctccaactgcagtggctcctccttctctgcccacatctgctggcaggggctgaggtgggcccatctctggggaatatgagtgcaggttgccacagtccctacattacaggagcagactctctaccctgggcattttttccttaagggccatgtccaagcaactcttttttttttctaggccaagccatatgtgccgtttgtaaaactgtccctgccttcctattttagctccaaactgaatgcaaattagcctttcagattctctctttgtatccaatactccacacctagagactcagagtttagttcaatgggaatgcacagtttttcctaaatttcactgatcttccaaactccctctttctccaatgctactactattagtcccattcaaagttttattacctttgccccagtaggtctccctactggaagtaagacgcctggtgaagcagaataaacatagatccttggcgcagtctcactggctaagacacttaatagtggtgttatttgaggttattcatattacctccttgaacctcacctcagtttcctatctgggtgaccagtagtgataataaataagatatgcagagagaactcctagcacattgcttggcacataagaggctctggatgttagcagcaatggaaaagttgaggtttatttcttggcttcagcttttaaaggaccacagcagtccctgcctatatctggcatgtcagaacagctctaaccacttgtactttagactctgcctcgatgcccttgtgagacgttcctgcctgcaaagacaccattacttgttcaaccacagtgggggccaggatttcctgtccatgccctgtctagccctgtggacgtgctcagtaaatagcagtggccaaaccaaagtcctataccaactcccaaccaccttcccaggtccacagtatcactctactttttttttccctaagccacataggttcctggtacattgcttgcaccctttgaatcaaagaggcagttatccccaccgcttgctgcaaatggagattgtgatgggaacttgctgtcccagtggaagtgatactgctagagggcatccggccacactagagagggcctgggctttgcaatcagcttatggagaggcagtgtagcacagtcaggagcttggcctctggagcttgatagcatggattcaaatcgcacacctgcctttcacttgcggcctcaggcaagccattcaacttctctttatctcagtttccccaactatataatagtataatcacgataataatattgcttgagaactcaatgacttgatacatgtaaagcatctagaatagtacctggtgcccagtagacactgagatgctagttactgtcatgttattcaaattctggctctgccacttgctagatgtgtgacctctctgagccttggctttctcagcttcctcagctgtaaaatgggagatcctattataacttatcccatacaattggtaagtgaaataatttgacaatgaatgaaaaacaagctggtatgaaggacgtgagtgcatgctgatttcagtcttcacagcactgaacaggagacaattagttcaccaacctcgtccaggggcattaggagcaggatctcagccctacttcagatagctaccaccacaagtacctgagtcatcagagcgatggcatcttaacccatgctgcaagtttttcccatttcttgaggggggtggagtaggagtggaaggttcagatgatgggcagaaatgggcatgtggtgtctcctaggcagccatccacgtgtcggaatgcctagtatctaagcagacctgcttagctggtctaacaagcattaggaacccaaggtatccctccctcagagtacaaaaaatagaggcatggtgtaggcacagcctcacccgcatgcattactgctgccaattgctgcaacctgcaaatcgtacctccatctcttatagagctgctggtcctgggctgacaccgctgcagccgtcatctcctcacttcccccgccccactcacccccaatctcagccccctttgtctactgtctatctgtgagtccttcttccagcaaaagtctctcaagctaagccaaaatgtccctttaagagatgataactcacttataagatgattacaatctggcagtcactgctctgagtcttaaatgtgttacatcacttaatccccacaaccaacttatgaagtaggtgttgttactacccccatgcttttagatgggaaagcttaggcattgtaagttcgggggaagaaattcaaaaccaggcagtctggttccagcttcggtgcccttaaaaccattattttatatttcctctcctctttttttcaacattatgaatatattcaaacatacaaaaatgttgaaagaagttcacagtgatcacccatatacccagcacctagattctacaattaacattttgatatatttgccttatcatatatccatttactcctctatccatctaccaatccatcttaaaatcctggtgcattttaaagtaagttgaaaacaactatatccccataaattttaaaatgtaaatgaaatggacaaatttcttgaaagacacaaactactaaagcttactcaaggagaaatagatgacctaaatgtccccaaatctattaaagaaattgaatttgtagttaaaaagctttctaccaaaaaacctccaggcccagatggcttcagtgatgaattcaagcaaacatttaaggaagacattttatacaaactcttcctgaaaataaaagagaagggaatacatcccaactcattttttaaggctagcattaccttgatacaaacaaacaaaaaaaacaaaaaacagaaaaagatgttataataaaactatagactaaaatccctgataaacataagggcaaaatccttaacaaaatattagcaaatctagtaacatataaaaggataatacatcatgaccaagtgggatttatcctggcaatgctaggcttctatttattttaaaaatcaatcaatgtcattcaccacatcagtagactaaaagagaaaaactatatgatcatctcaacagatacagaaaaagcatttgaaaaaaaatacaacatccacttctgatgaaaactctcagtaaactaagaataaaagagattttcctcaattaaagggcacctacaaaaaaatcctacagctaacatcaaactttatagtcaaagattaagaaaaaagctacaatgtccactcttaccatttcctccaaacattgtattgaaggtgagagtgcaataaggctcttctctctcccagaaaagggcatgtacaggagaaaggaagacactaaattctatttggagatggcatgattgtgtatgtagaaaatgttttataatccaccaaaaagctattagaactaataagtgagtttggcaaggttgcaggatacaatgtcaatacacaaaattcaattatatttctatagactagtaatcaagaatttcaacttgacattaagaaaataatactctttataatagcatctaaaaacataaaatcttagggacaaatatccctggtggttgggtggctaggattcggcgctttcataaaatctcagggacaaatataacaaaatatgtacaagatttgtatgctgaaaacataagttgaatacagcagtatacttcaaacacacttcagcatacatattaaataaagtttaatatttgtttacaacatttttaggcaaaatttacttccagtgaaatgcacaaatactaagtgcattggctgtctaggagccttgctatacatttgttgagttctgacaggtacatatgtttaactcaaactcttaccaagatatagaacattgtcaccaccccacaagttccctctgcccttttccagtcaatctctgtgccacctcccattggcgagcagtgttctgaatttgttcccccatagaatagctgttttagaatttcatataaaaggaattgtagagttcatagtcttttgtgtaaggcttctatcacccttgaagttcctttttaccaaggatatatattgagcaaattcagatactaagtcatttcaaaagtgtctgtgtatgcaacagctgaacacaggaattaacttctggtttgaatgcaccggccaaaagatggcatcagggatgccatggggaagtaatctggcagtgagtaggcaaggacctagggagtcctcccagaagtagcctgggggatggtggtagcttgtgttatggtaataggtcataaccgggatataagagcagccagtttagacctgggtctccaacagagacaggatggagaaaggggaaaggatttgtctttttaaaaacccaacaagtcagatctctgaaagcaaagcctggggatatttgcaagttttgcatctctaaatacttctgaagtagaaaatgggaggcaataagtgatattttgtatcatgcactgggcctagaactccatagacacaatctgatttgattctcacaagtgatccatgaggcggccatgatattcctccattttagagatgaggtagtgagactcttcttaatactggctattttatgacagaaaaattattttttccctttagaattacatacttcaaatttgtgtggttgaatgacttgctttgggtcactcagatatcaattttatagtcaggatataaatctcagttgtgcccattttatgaagcaaaagttacttttatctaaccctaaagatgagacaactgcaattttggtggctgagtatctttttcaaggttactaagctaacaactactgaagccagtgctgtacagtttcaaggaattataattgttatatttttaaataatttacgtagctttcccctctcaaagacaataatgaaggttacccacccaagaaccaagtcctcacctgcactgtcagcttcctgggtttccaagtgttgccaggtgccaagctgctgtcctcgagggcactgtgctgaggattatgatagcaaactgaacaccgaatgcattggtggtggtggcaccggcagttgtagcaatttggcatcatatttctctttagcaaggcagggcagatttccccagaacaataaatgcaaggatcatggactagagctccttgaacactgcaggagtaagagcaggtcctgtggtaatcaaaatcaccacagtgtagtggcttacaacacatggaattttctagacctttgcttgcaaaacattctgagtaagtgggagtttctgactgaaggggtgacatggaatgatatgattggtctgtggcatgatatggttggtctgcggaatgatatgattggtccatgggatggcgcctcaattccctacagctggagctcattggctggaagttttggtctataggttttggtctctgggtaaaagtcttgttgctatgagtggttaaacctggcaaatgagatgtagataaggatttgctactctcttcaaagaactttcttctgtctgcaaaaggcaagaggatggcatcctccccagcttgagcagtagaagccttcaattccttgttgtcacctgggttggaagggccttccatggctgctgccacaagtggctgtgaattatgctctggagaccatctccaatgacctccacggactccacagtgagcatgtgctttctcagggtctgaggaggatgggtcaggtgctttccaccaggtgttcaggcccaaagaggactggccaggcctctggccagggcttattcgtccctctaagcctgtcctagattcatggctctcaggggcttggctgaggcactcggaagacctagctctgagcatcatgcttttgttgaagagcttgtctctggggctgggaggttttttacatgaagatagaagagatgtgttagaggcagtgagtggaggactttctgggggctcctgggtctcttccactggctccttagtgtcacacagctgtgacaagggacccttgcttttctggagctgggccttcctcctctgaatttcattacgcagattggtagcaaaacgctcactcttccgccggttttggatcgagcggccccgggtccctccacttcgcctaccacccatccggctgcactccttgggctcgctgtccccttcttcacctgcctctgtgccactagctgctttagtggttgaagaacagtccgtggcttgttgaacaagggagccagaggcagagggttgctggttggccaattcactggctgctctgcttgttctgtttgggtccaggaaacctttttctgaggggtgtccatcagcctctccatgtgggggactgctttggctctggtgtcccaaaactaaagacctgtcatccacttgtctggtctttctttctttgctggactggtcatgggttcctcctgtaggggggcatggacttttcttccctttgtggctgctgtgcaaaggggacagagtccactggtgcccatcctgtacgggtgggagctccatccctttgctgcccctggtatcaaggtgcacatgctgcaggtgggatgccagcagctgttcaggggcactatggcgatgccctgtgggtcctatgagatgtggaggtctgccaaaagaagccttagctagctctgcagaagcctcattgagtgggttggaatccacgctggaagctctgtcacaggcttttggggatccaacagctttggttgaggcctgcatcagtagatgctcagagccctgttggctggattcaggaggctgactgaactcacagttctgatggccctcacttgtcacttggtcatgcccactgaggcaacagaacctattagggttccttgcgggtagcacaggctctaagctcagtttctccttctgtggcaaggggaccacaggctcagatgccctgcgctgctctccattgaggagttgggctctggaggcctgaaggctgtcccgcctcactggaggttgtggtgggcccctgactgctttggcgggccctgactggtatccctcctgtggacgggatgacatctgagagctgggggtcaggtggcccccattggtgcgccgactacctcctgaggtctcagccacattaggccggccactgggggccttagttggccctgggccttgcatgatgcagtctgtagaggctggctcctctggcctgagggaaagggcacagtcagaagcatttgagctggccgagaaggagctgtaggctgagtcacgctggttagggtacatgttctggtcaataggcaacagatggctctcataggtggcttggcctggttgctccaggctctccatgctgccaatggagctgcttttctcggtgctgcaatgccgggagagtggacaccactgcacacacacgtcactgtaagacacagggcatactggttagttagcgaagtcatggccagccctactataggagagggcaggccagcccagaggtacccatgccacaaaagagaggagggtaggcaaaaaaaaaaaagggggaagaaagggaaacagggaagaagatggacattggggtgcctcaggggcttagtaaaatgggacacaagatgatatatggaaaaaagatggggaaacaccccaaagactaaaagtgggagagctctatgggggttatcctctatttccctgacattagcaagtctgaaattgcttctaggctgtccctgtccctagggagtcagcatgtggctccctgccaaaagagacaatcacagaatatcagcattagagaggggccctaaagggctgattcagttttagccggaccattttgtaaataaatcagtgattctcaaacttgagcatgtgcgtcagaatcacatgcagggcttgttgaaacacgggtcacttgtcctcatcctagagctttaggtctcggtgaatcctgagaatttgtacttccaacaacttcccaggtgctgctggggctgcttgctcatccagcaatcacacttttgagaaccactggtgtaaagcaagcccagcaaagggaagtgattttgagatggtgatttactcaagaacacccagctctaactactggcacagacagggctgtaattcaggtgttcccctattcttttcttgataatagcaatcctgactatttactgaggacctacaatgtgccggacactttacaaggtttcatttcaagctgaagaggacagatctttttttttctttttcaacctttattttagattccgggggtacacgtacaggtttgttacaaaggtatatcacatgatgctgaggtgtggagtacaattgaactcatcacctgggaagtgagcagagtacccaacaggtagtttttcaacccttgtcccacttcctttctccctgcttttgtattctccagtgtctattgttcccatctttatgggacagattattatctacacttcacaatggaagaatcttaagcttagagaggtaaagtaaactgacaaactcactaagctgctgaagaagcacagctggaatctgaatcaggcctgagtccagtgtcttagcgctactgccatatggtcttttaaataggaataatagtaatagctatatcagagggttgatgtgtagataaagcagatagtaaatgtaaagtccttaccacagcccaggtacctagcaagggttcaatacatggcagctgctactctcttgattattagtttttgccatcaggatcctctctaatactagtattgataatataggggcctctgcccacccacgcctcccccaactcccacagcaaagccaaacctggaagaccaagggaagggctaggatcagatgcaatcttcaattttaagtaccatttcccaaacacaaagccaaactgaaccaagtcatgccagtaactccctttgactagaacccgagaggttgcaggctgctctcagaaaggccatagtctagaaagccagagttgaactgtggcagcagcccatgagaccctcaggtcattttctgctcattcttgctccctgccttgccccttagtcagtcagctcacttgttctctgggcaaggaatccatcaatttcttattggcaagggaacctgctacccactccaccactattcctgctgaaaagaacaaaaacaaaaacaaatcctcactcaaacaggagccaagctcaagaatgtcaaagtgtgtttctgcatattcttccagaacaaaactgcctgtgccctgagcccttggtttccaaataaagtcaccgaattggggtaaacgcaacccttagtttctctgaacctgcaacagaaatcccttcttggagggaagctcttgtggaagggaaaaggcagtgaagggcagcacctttgctggctctcagcctgaagaaaacgttgtctgcctcttgggcaactgtttcaacaatggttattcaggaaggtccctattttgaaggctttggctatgtgacagaggtaataaagaccagataagggcaccagtgagtcgccattgacagagaagcaggccagaactgagccctggggtcctcctacattaagagacaggagaacaaaaggaattaggaaaagagatacggagaaagaacagctagtgaaatagaatgaaaagcaggacagtgtggtgtcttgtaagcccaatgaggtatttcaaggaaacatcatccagaaggaaagggactagcccaaaatcacagagaattagcaagagactagcacttgaactcaggtactctggactcccacttgcttttccattatagtacttgaggctctaacatccaacagggactagagcagaggaggaggagtgtccaaggtgtctaccctccagcctgtcttgaggggagggctctagactcaccttgtgttgcagccagaatgccaggacaagctgaaggcttcagaagggaaatgcatggtggtggctgcttcagggcatccctccagcagcttggccacatgccatgagtgcggcctactgacaggggcgttcctcctacagcaagaaagggacaggaagtgggctgaaggaaccagagctgaaatcacttcccaggcagcttccgccccaccccctcttttccttcagtaaagtagaacatcttgcaaggaactggtgtgggaatcttagtggccctcctgagctcctagttctcaagtctccttcattctggagatatggaatgtcagcttcatagggctgctttgttcacaagagtatcctgagcacgtatcacagtgctggacacatagtagatgttcaataaatatttgtggaataaatgagtgctgctgcctaatgaacagtgagcacatcctcacttctctttgagaaagaaaatcaatctggtcaatcttcccatttttctctgagaaaggaatgggcaagtgattgaaaagtttgaacaggtcaacactgggctgtcaattctccaatttttagccattcattgaataagcatttgttgtatgtttactgtgtgtcctctacgtgtaactctgggattacagagatgaatccaatacagtctttgctcttgagagcttacagactaatgggagagacagagctggttcaaacaaagcatgggataggtattgacagagtgaaagataagatgggtacagaggtgagacacctgagttggtaggcaaactggtggcaggaagccccaactcctgtgagggaagatagaacaaagtggtgaatgcaccatgttaggctgacagaggagattggctgctcagcaggtcaggggtatataaagggaaataggcctgaggccatgactctgaatacagccacaacttttgcactgactgccacatacaggacccatcgctgtcccctggcatacttcgcatgagcagttgccacccttgcgagtggggaagagtagtgtggtgaagagtacatgtggggcatggataatgccaggagataaaaaggtgattgatgggagggagaatgacagaaggagggagagtagagagagaatggagagagagagatgctggaagcgccagacaaatgatagagataagaaggagagatgatagaggggaaaataaatgacagaaaaagagaaaactctgagaaagattgtagagaaatatatagtagagagaaatggatgacagagaaagaggtgaatggcagagtaaaagaaacatgataaataagtagatgatacagaagtaaacagaaaaattattttcatcaatttattcatatttactgtgccagggtccagactaggcactggtagcacagggttgaataggataagggcccctgccttcaacaagctggctatatcgtgagataaagcagctctctacctcccaggagcattcatggtcacactcaagctggaggattccatcctagctggaaatgcccctcaccccagcagaagcatagaagatctcagtagtacaaggctctagagggctaaggcctaaaaagatagtcttcagaagaatagccttgctggggaaaacaaggattgagtggtaataggccagacacagaccaggaggtataggaggaagggcaggggaagctgtttgtcaaaggccaggaagtatagccacaggtcagcaacagtggctaagatttaagcggaggaaagccaggtgaagcccctagctttgtaatcacattgttctattattgatttcagagtgcccagagtgggggctgaaggcacaaggagaccttgggggctatgcttgctctggagtcctacacacaaagccacactgccgggaaatctctccagctgctgctaccaggtagttatccggtcaacaactatttgtcaagcatctaccagtagtagtactatgtaccatgggtatctactatgacctatgcttttagacactgaggatatagtggtgaacagggtatccttcctatttcaagcctttttccatatttagggttcttgagttctgggtttaaagtgcgggcagtcagccttggtgccaccttctccctaaccatccaatcccacacggagttctactgagtcttttttttatgatgtttctctggccctggtttgctctctctctctctccccctaccccccctccattttcactgtggccattagacagaaccacagctcttctcccagaacccaccaccagcagctcctgttctagtccaggcccttgaaactttatgccccaaatactgcagaagtctgccggcctgtctgccttgttctacctccagtcactgcttttaggtcatatcatgttaaacgccaactgaattggggtactctcctattcaagaatcttcactggctccctatttcttactctgtcccacatcaaacgtaaactagatcagtttcaaagtcttcaataagctatccttacccatcagctcaatctctcatttctctgctccaatcacagcctgcaaccagctctgtcccttcctgattctgtgcctttgctgttgatattcctgttgatctaacacaggctctggggtcagaccacctttgtttgaatcccagctctaccactcattagctctgttgctttagacaggtgacttcacttctcagagccctagttttcatggcagtaaaatgtggataatagtaccaaatgggattgttgaaagatcaaatgagacaatgcaagtgctttgaatcaggcctggcaaggcctcgaccaatcatagttatgactatgactgttccctctgcctggaatgccccctctccttttgttaacctaaatcctacctgttcttcaaggtactgctcaagtaccatctcctccaggaagcttgttcagggtaatctagccctcacaattgggtccataataatatgatatttgatattgcccatcatcatttcatgtgtgtcagtctcatctcaccaactataccaagccagtaggcaatgggtgaaaaatgagtgagacagatgtaggttcagatcccctctgccactttagatgtgtgtatctgtaagttgcttaacccatctgaaatttagttttcttatctgagaaaggaaacaataattcctatctggctaggtgactgtggggattagagatagtattctcaaagcatctgggacacagcctgatgcacagcaagtggtcagtaagtagcaggtactataataatggttattagctcagacttgtaccttttgatggctcaagagtacccacacctagggtaccatccactgttgaggttctactgtaccactaccttgccacactgtgaaacataccttacaaagactcttactattttttttttttttttgagacgaagtctcattcttgtcgccaagcctggagtgcaatggcacaatcttggctgactgcaacctccgcctccctggttcaagcaattctcctgcctcagcctcctgagtagctaggattacaggcatgtgccaccatgcccagctaattttgtatttttagtagagatggggtttcaccaggttggccaggttcatcttgaactcctgacctcaggtgatccacccgcttcggcctcccaaagtgctgggattacaagcgtgagccactgcgcctggctggccccttactctttctagggtttctccaggagtaggaaccaatcccaaagtagacagaagagggaagtgggggcttttaggacacagagaaaactaaagactggaagaagaaaaatccaaacagagggagctggagccagagctagagccttctaaccctagtttgggacaggagaataaactatctatatggtctactatttggcctattattagctcggaatagccctagacttgaagtcagtctacacttgcattcaaactgtagttgtgtggccatgggcaagtcacttctgcgagttgcagattttttatctgcaaaatggggaagatgaccatctgtttttcatgagttatgttttggattaaatgcagtcccatgtgtgaaatcaaccagcatagtgcctgacatactgtataaacttaaagaaaacacacagcaggaccacttattgaacactgaagatgtgccaggcactaagcatttcacatgcattaactgatttaatcatctctctaaccttatgtgaaacagttttattattgttattattattaagacagggcctctctggctctgttgcccaggttggagtgcaatggtacactcatagctaactgcaacctcagactcctgggcataagctatccttctgtctcagcctcctgagtagctaggactacaggctacaggtgcatgctaccgtgcccggctaatttttttgtattttttgtagagatggggtttcaccatgttggccaggctggtcttgaactcctggcctcaagcaatcttcctgcctgagcctcccaaagtgctgggattacaggcatgagccaccatgtccagctggtaagttattatccccactttacaaatggagaaccagagatgcataaagcttaagtgattcgccaagagcacatagctaataaccagcagaattgggaatgaaactcagatcctccagttttttcctaggataccacacgacccctcctctccaaggaagagtctatctgaaaaagcctgtattcctgaggtttcccatagcaattccctcaagaagcagtcagcaaagggaggtctcattagtcctagagctgaaaccattccctccataggcagtggggagagagaggaggagaaacaaacagaaaagtaagaaaatgcctacgaccaaccatgcagctctaggccaagatgtgaaggcagtgaccccagtgcttgcctttctcctaaggctggctcaggcactatcaataagcacacacctcatcccatccttcattactccaaaatgcttttcttaggaagcaaaaagaaagagatattgaagaaagaaagcaagagggggaagagtggcagcagccatggctactggctgtacctaccatggaagttgcccagggtggagagatggcttgggagagagcggggtatccggctagctcagactctcgttgacaaaccctccagccagcgtcctcccttagctgggacccatctgccctccagttaagaccttctggggcgagggaccatcagcccaagatgctgagtgtgatccaaggggctcaggcacagtcaggttccagttctaagaacaggaaggagtagcactgaaggcaaggtatgaccatcagcctggatggacctagatatggccacagccttagggaacgaaagccagtgtcaagagctggataggagtgaagacgctgctccaggaaccagccagcaccctggtggcaaagggaaggatgaaaggcacttccagcagcataaacagcccccctgctccctactccaacctcctctgagccctggcccaccccctcggcagctcagaggccaataaggaagctgggcccccagccactgctagaactcaggaaaggagcaaggaaatgatgtttgggaaagataaagcgggtgtctaaaaagaatttttaaaaatacacgtaagtgagagagaaaaataccccagacacatacacttaaaagaattcctgtgcttcctggactgagttgaccccacccagccatctctgcaggtcctctgggccccagaaaagtacagataagccaggactagcagcctccaggtccagaggagtagcactccagctgattttatatagctgggggcaagtgactgagagattttccaaggtgaaggtcctggtgagatacgaaggctcacaaacattttcggatgtatttacaggggtctgcacttcctgtgcggacttgagcagatccaaagaaaacccaattttacaccagagacttcaactccagaaaaggtgcccattagcaatgctggaaatgtggtgtttggggtcagtgtccctggatttgccatgaattcactctgacctctggcaacttactcccactctctgggcttctgtttcctccctgtaaaataaaacattgaattcaatcgtcacaaatgacccttcccactctagcatgctatgatgtagtagtcctaggccccaggctgaggttccaaatgatgccctaagtgattagcgcagtagccagaatccagagcagccctatgtggatttgttgcaccccctaagcccaggctcaggcaccaggatttaatttatcttggggaattagagtcagggttttcctttcattaacactcccaattccctactccagtttcccttggcctctggcctcaattccagtaatttctggctcctgagagggcttatgcaaactcccttaggacatgaagtatgtatgctagggcctttcctctctggggaaatcatgcctggaggccccttcccctttcttccctctgtatctcacaggagagtctgggttgacttttatcaactgtataggggaaagtttgggagctttgaggagcatatggatctggcttacagtctcagctctaccattcactagttgtttggccttgggcatgtcacagaaccttggtttcctcatctataaaacatgcctggcatgtaaaaggcactcaataaatgctatctgtttttaatattacccgtatgcaaaataataatgagcgaggtaccattagcaataagaaaactgatttcttcaatccaaatgaagataaaagagaaaggactagttaagagaaggctcaaatgccaaacccagtacactctggaacagcactctcaaattgtagtgggcatactaattacctggggatcttgttaaaatgcagattttgattcagcgaggcccaggttctgacttttaataagctccagagtgatactgatgctcctggtgtgataaccacattctgagtggcaatataccaggacataatctggtccaaaaaatgcatcaggttaaaatctcttttcatttcattcctcaggcctgggtgtccggccgcccttgctcttctggtcgccaaatgtctttctccttttgctcagtggcccagcccatgcaaacgcttgcctgaagaagtttgccaatccccacttcctaacaaaataaagagcaactggtttgttatcagtgtgaccctgccagtggccaggtgaggctgaagaaattgtgactagaggtgcaagcatgttcatggagctggctgaggtagggagaaagggtgcgaagatgagagttgggatgtcatcagatgaggagtaggcaggtgggcacaaatagtgtatactcaagaaatccttcgttgagggaagatgagagagaaacttgagcggtttagccagtttgggatttggggaagaggttgggagaggtggtggagggaaaagggcatatgctcccatttagcggagctgagttccagataacatgatcaagtatgacctcctgtgctcaggggacggtaaagatgactgcttcttttccaagtactcaggagacgtgaacttggcatgggggcacaggagggtgggcacatgcagcagaaaagccagaagctggctcccaggagaggccttataaaggctcttgtgagaggtgaggggtggaggtggaccaattctgaaaggagtcagtctccagctgcgctagtcagctgtcaccccagtatcttccgatagcaccatctgtctttgagcctggctcccagcagacccctgaagagatacttgggagaagatgagcagaaagagaaccatgactctgctctaacttaggggaaaaaggaaaatgtaacccctgttgcttgtggttgtgctcaacctgaggcctggaccataacagagtgtgggtactttcctctttttaaagtatttatataaatagaagcacaaaataacgtccttgattagctctgtttattttctgtggctcttccagcctccctccaaacagcacattccacctgccccacacgaagaagcccaagctcattctggcaggctcagcaggaagggaagcccacagacaagccggaggacagaacaatgcatggcttgtttatttgacagaagaggggaaaagctgcctggtcaccatggagggacacagagctctgaaggcccacccccacccactgttggctggggtccttgcagcctggtaatcaggaaacccttccttattatagacccaaccaaggggggaagagtgtgtgtgtgtgtgtgtgtgtgtgtgtgtgtgtgtgtgtgtgtgtgtgtaatttgaaagagaactttcaggacaatggctttctcatcagtctgggaaagctataatctgggtcatctgagagatgaatactctctggagaaggggcttttggtacccagctctgcctccctgcctcccctcctctccccacctcctctgaatagccagttcaagttcttccatgtaaatctgctgggtccccctctccaccctccacctcagaatccatccctggctacaaagaaacccagggtagggaataagaaaagaagggaatgttcgagtggaaataaagactccccacaaatgctgtggtgtgtgtcaggggtgctctttgtctttctgcatagggagtgataacttcatctggctagggcattacatttgaccctctgcttccatttctccattttcacattgaaatctttaagacacagggggacacctctttttccaaagaaggttggcaggaagtaaccatacagatgactcgggaaagctctgcacatagcagcgggtaggaaaatgcttagtactttagaaatgcagtactcgggattctctttcagaatgggctagagagaaatttctagtttttctatatatagtgtgataaaacataccagtcatagacttgtttaactgacagaagagggaaaaagctggctgatcttatcaatgatcctaaaggcaaagaggtggatagtgaatatttcgaagcttctaggagcaaggggagcaagtccagaatctgaataatgaaagagtttttttccctctcccttctatgtacagaagttaagggtgcaacaccagagggctaagggagacttcagaggagcacatagggaaaatggcatcaagttcacagtgcaccatctgactcaacagatagccttaaaggttttgccatgatgcccagtttcctaaaccaacacccaaagcgataaagaaggtggaggatgtttgtcctccagctctggtttctatcagtaacatttatagcgtcccttgggaaagaggctgtaggaataataccagttttcttttcttcctccttaaagcccattatccctttcagttcaaactcactgttcgacctaccacttttcagaggtctgatggaatccataaaggttttccccagagtcaagtctcaaaatcctcagaactacttctggccactccccaggtcatctctactactaaagacatggagccctaggacaataaccaacaacagttaggaccccaatagaaacaagaacacccagtcactctgctttgatacaacttgacaatcaggaggagccaagacccagcagagctggagcacagtgagcaaggtggactgcagtgggagatgatactggggaggtgcataggccagatcatggagtttccaaaggctgaaacagtttgaattttattctcagtgaaatgggaagctgttagaggttgttaagcaggggactaacatgatgtaagttttataaaggtttgacttggctgatggatttgtgtgtgtgggggtcaacagtagaagccagagaaccatttaaaggggctattataggtaagagataatggtggtttgttctaggaaagtagcagttgggacaagaacaagagatttgattagaggtattttgaagaggtagggctgacagtatttgttgatggactgaatatggagaatgaggaaaaaagaatgagctatgatacttgagtcacctggcatctgtaccttcttagcacagtattcattcctgaaactgagtcattaggggctctaaaaagaaaattggcagtcttcactattgttttgtccaagcatttacagagctcctctatctacatttaaggtgtttggagaggtactaggcaacatgccaaaatgaagaagaagtaatccctgtgctcaaggaattaagtgtggtagagggtggatgaaaaatacctagaaaaccattaaaaaggatggaatgtcagaagtatcagaaaggaaatgctaacaaaatgagagtcaaaagaaggagagagcactgctgcctgaatcaagaatggcatcacagagcctctgagctgattttggaagagtcaatacaatcaccactgaagatgactgggagagaggccatgccagatttgcatgaacagaagtgagaagcacaggaataccatgaaggaagaaaacacagtttttataaggcacagaggaagtgaaattagaatgattcaagagcatggtgggccttaagagtcaagttaaagcctttacttcacataatccaataagcaagagagagcccttggaagttccagagtaggagagcaatatggtacgagcggtattataggaaagttattatggtagccatgtgtaggataaattatgtggatagatactggaagcatagagaagtgagtaagctaatggaatagacacaataaaaggtaaaatcagagcaatggcagtggggatggagcagaaaggaagaatgtgacagagaatcaacagcgttggactgctaattacataagcagagagaacagatgactgtgaagcacctagaaggctgatatcagtaatctaaatagcaaagtcataggcaagaaccagctttaggaaacatgagtttgatttcagatattagtttgttatgctagcaaattctgtaggtaggtgtgcccagcgagcagcttgatgtgtggactgcagtgctagaaagaggttggggcacggtatggacatgtggtcactatccagaggaggcagccgaggctgttgccgtggatgtgactgcccacggtgaatgtatgcaaaggagacgggggatgatagatctctgcagagctatagttcagtgagaagaggaagaagagctggtaatagagacaaaacaatgaaatgccattttcagtcatattggcaatactttctaaaggtaagtgctgacaaagttgtggggaaatagatatacattggtgggtgggaatggaaatgggtacacacttgcttaagggaattttggcatatgttatcagaagacttaaaatgtttctactgtgcttgctttggctgacataactaaaattgcaatgatacagagattagcatggttcctgcacaaggataatgcacaaatttgtgaaatgctctgtatttttactgcaattagtggtaatggtttcacaaccttgtgaatgtactaaaacccactgaattacacacttgaaatagtgaattttatggtatgtgaattatatttaagaaatttcatatcctttgatccagtttttccactcctaggattttatcctaagaaagccattaaagatgtacacatttatttatgtacttgaagtgtcttccactgcagggttattcataatggtaaaatttggaatatcctagctgtccaacatttaggaagagttagaacatattgtgcatttacatggaggaataatagtttgtcattacaaaccatgtttttgaagactacttaatgatcctgaaaaaggctcacaatgtaatggtaaatttaaaaattgtatataaacctgaacatattacaagttcaattcaagaactatatatgcatatatacatattcttatacagatatgcaaatattgaaaggctggatgtaaatgtactaatattgtatcagtgggtatttatctttgtgtggtggaattaagggttatttttatttttcatacttttaaatcatttctagattttatacaccacacatgtattaccttttaaataaaaagaggtttctttttttgagatggagtcttgctctgttgccagactggagtgcagtggtgtgatcttggctcactgcaacctccgcctcccaggttcaagagatggccctgcctcagcctcccgagtagccgggactgcaggcacgtgccaccacgcctggctaatttttttttttttttgtattttagtagagatggggtttcaccatgttggctaggatggtctccatctcctgacctcgtgatccgcccacctcgatctcccaaagtgctgggattataggcgtgagccaccgcaaccagccataaaaagaggtttctaaagaaaaatgtcaccattctacatggacatatcatttacccaggcaactgtctgatataactgtctgacatattcttaaattaggaatctgcaattatactggtgatttcacttaactatttcaaagatctagatttttccctcagggaaatcagcctagagcccaccaacctagcaaaatgctttttttccacataattttgctgcttggcagtggattcttttgtcttactattttttaaaaattccatctgacagttttttacccttaatattagcactgggagctattctttgctgtgagagtagaccagggctggaagaaccaggagcaagtttgagaggaggccaggcaaaggaaaagagaagtcaagtcaaggtcagtatcaaggccatgcccagtgtgttgaaacaaacaaacaaaccaacaaaaaaacactactcagggccttcctgggtttagttcttttccagctgcctgatagacttggtgggacaaagttggctagagagggaacaaaagtacaagaaaatttagtggtggtggtggaggtgtggcagcaagtaccatttgtaaagccatctaactgctaatatttttatgcaacatttacagttcataaagaactttcatatacaccattccatttcattctcataaccttactaagtccacctcagaaaagaagaaactcaggcttagggaggtgaaataaatcacataaggcttgaacacaagttttttgcatccaaatttctatgtcccccaacccccaaatagtgtttttcaaagttgttctatagaccagcatcagcatcacctgagaacttgtaggaaagaaaattctggggacccatcctcgaccttttggatcagaaactctgggggtggggcccagcaatatgaattttggttttgtttttatactttactttctggaatacatgtgcagaacgtgcaggtttgttacattggtatacacgtgtcatggtggtttgatgcacccatcaacccatcatctacattaggtatttctcctaatgctatccctcccctagccccttaacccccgacatgccccagtgtgtgacattcccctcccagtgtccatgtgttctcattgttcaactttcacttatgagtgagaacatgtggtgtttggttttctgttcctgtgttagtttacctagaatgatggtttccagcttcatccatgtccctgcaaaggacatgaactcatccatttttatggctgcatagtattccatggtgtatatgtgccatattttctttatccagtttatcattgatgggcatttgggttggttccaagtctttgctattgtcagtagtgctacaataaacatacgtgtacatgtgtctttacagtagagtgacttataatcctttgggtatatatccagtaatgggattgctagatcaaacggtatttctggttccagatccttgaggaatcgccacactatcttccacaatggttcaactaatttacattcccaccaacagcgtaaaagcattcctatttctccaaatcctctctagcatctgttgtttcctgactttttaatgattgccattctaactggagtgagatggtatctcattgtggttttgatttgcatttctctaatggccaatgacgataagctttttttcatgtttggccacataaatgtcttcttttgagaagtgtctgttcatatccttcacctattttttgatgggttttttttcttgtaaatttgtttaagttccttgtagattctggatattagccctttgtcagatggatagattgcaaaaattttcttccattctgtaggttgcctgttcactctgatgatagtttcttttgctgtgcagaagctctttagtttaattagatcctgtttgtcaattttggcttctgttgccattgcttttggtgttttagacatgaagtctttgcccatggctatgtcctgaatggtattgcctaggttttcttctagggtttttatggttttaggtctaacatttaagtctttaatccatcgtaatttttgtataaggtgtaaggaaggggtccagtttcagttttctgcatatggctagccagttttcccaataccatttattaaatagggaatcctttccccattgcttgtttttgtcaggtttgtcaaagatcagattgttgtagaggtgtggcattatttctgaggcctctgttctattccattggtctatatatctgttttggtaccagtaccatgttgttttggctactgtagccttgtagtatagtttgaagtcaggtagcatgatgcctccagctttgttctttttgcttaggattgtcttggctatccaggctctttttttggttccatatgaaatttaaagtacgtttttctaattctgtgaagaaagtcaatggtaacttgatggggagagcactgaatctataaattactttgggcagtatgaccattttcacgatattgattcttcctatccatgagcatggaatgtttttccatttgtttgtgtcctctcttatttccttgagcagtggtttgtagttctccttgaggtccttcgcatcccttgtaagttgtattcctaggtattttattctctttgtagcaattgtgaatgggagttcactcatgatttggctctctgtttgtctattattggtatataggaatgcttgtgaattttgcacattgattttgtatcctgagactttgctgaagttgcttatcagcttaaggagattttgggctgagatgattgggttttctaaatatacaatcatgtcatcagcaaacagagacaatttgacttcctctctttctatttgaataccctttatttccttctcttgcctgactgccctggccagaacttccaatactatgttgaataggagtggtgagagaggccatccttgtcttgtgtgggttttcaaagggaatgtctccagcttctgtccattcagtatgatactggctgtgggtttgtcatatatagctcttactattttgagatgtttcatcaatacctagcttattgagagtttttagcatgaagggtgttgagctttatcgaaggccttttctgcatctatggagataattatgtggtttttgtcattggttatgtttatgtgatggattacatttattgatttgcatttgctgagtcagccttgcatcccagggatgaagccgacttgatcgtggtggatcctctagatgattctaatgcacgctcataagtttgagaaccattactgtagcatacattttaaaacagattttcaagtgacttctaaatacgggctgctgctattttggctcttgtggggtgctgctttccaaggtaggctggaagcctacctttagctatcagtgctatgtgtataatagagggcagctgcttaaaaagtatttaggttccagggacaggaatgttcttctttagggtgaggaagctcccaggaccaagagggcaattcttgaatcacagctgcccttgtcagggggagataagtgctggtgagcagttgccatatatgtacttccctggtaaggcttcttttcattaaggcttttgtctggttccacaatgttcacataagcccttgggaaatttctctttctgaggtatttacattcacaaacctcaagttcatcaagctgttcatttcattttgcatagctttattaaggtttagttgacaaataaaattgtacacatttataatatacaatatattttttcatacatgtaaacattgtgaaatgattaaataaagctaatttacatatccataacctcaaatacttatcattttttgtggtgagaacatctaagatctactctcttagcaatttaagtatacaatacattattattaactacagttactattctgtatattagatttccagaacgtactcctcttgttcaactgaagctttatagcctttgatcaacagctcatttcctgccccacccgccccattcctggtgaccaccattctaccctctgcttctatgagtttgatgttttactattataattattatttttaatataatttcaacctctatgtgagattcagggggtgcatgtgcaggtttgttacatgggtatattgtgtgattctgaagtttggggtatgaatgatcccaacacctgggtactaaccacagtacccaatagttttccagtccttgtccccctctgtccttccctcccctatctagtaggtcccagtgtccattgttgccatctttaggtccatgagtacccattgttcttacttataagtgggagctaaacatgtggtatttggctttctgttcctacattaatttgcttaggacaatgacctccagctctgtgtatgttgctgcaaaggacgtgatttcattcttttttatggctgcatagtattccatagtgtatatataccacattttatttatccaattcaccattgatgggcacctaggttgattccatgtctttgctattgtgaatagtgctgcaatgaacaaacaagtgcaggtgtctttttggtagaaacatttattttcttttgtgtatataccaagtaatgggattgctctgtaagagttcagcttttttacatttcacatatgagatcatgtggtatttgtccttctgtgcctggtttatttccttagcataatgtccttcagtatcatccatgttgtacaaatgacaggatttccttcttttttatggctgtatagtatttcattgtatatgtgtgtgtgtatatatatatttcatatattttttatatatgaaatatatattatatataacatatatttttatatatgaaatatatattatataacatattttctttattcatcatctttattcatcataaagaataaattcattctttattcattcatttataacacattcattcaagtgttgttggacacttagatttattccatatcttggctattgtgaatagtactgtaataaacatgggagtgcaaacatctctttaacatactgatttcatttgctttagatatatacccagaagtaggactgctggcttatattatagttctatttttagttttttgagaagcccccctactgttttccataatggctatactaatttacatttctaccaatagtgtataagggttcctttttcttcacaccctcaccaacacttgtctttttgattatagacattctaacatatgtgaggtgatatgtcactgtggttttgatttgcatttcactgatgattagtgacgtcaaacatttttttaaatatacctgttgaccatttatatatcttcttttgagaaatgtctcttcagatctttggcccattttgtaatcaagttatttgttttcttactattgacttgtttgatttccttatatgttttggatattaactccttatcaaatatgatttgcaaatattttctccaatcctgcaggttgtctctttactctgtggattgtttccttggctgtacagaagctttttaatttgatgcaatccaacctatttttgcttttgttgcctgtgcttttagggccatagccaaaaaatctttgccaaagccaaatgtcaaaaagcttttccatatgtttccttgtagtagttttagagtttaaggtcttatgtttaagtctttaatcaattttgaattggtttttatatatgatgtaggataagagtccaatttcattccgcatgtgaatatccagttttcatgacaccatttactgaagagactgtgctttccccattatgtgttcttgacacctttgttgaagaccagttgactgtaaatgtgtggatttatttttgggctctctcttctgttccattgaatggtatttccgtttttatgccagtaccatactgttttgattactatagttttgtagtatatttgggatcaggtagtatgatgcctccagctttttttttttcctcaatatttcattagctatttggggtcttttgtggttccttacaaattttagaattttttattcctgtgaaaaaatgtagttggaattttgatagagattgcattcaatctgtagattgttttcagcagtatggacattttaatgatagtaattcttctaacccatgaacatggaatatctttattttttatttatttgtcttatttattgtgtcctctttaatttatttcatcaatattttatagtttttagtatacagatttttacctcattgattaaatttattcctaagtattttagatttattttgatgctattgtaaatgggatcatttttaaaatttctaagtttgttgttagtgtatagaaacattattgatttttacagggtaactttgtatcctgcaactttactgaattcttttattatttctaagagccttttggtggacttctagggttttctgtataagatcatgtcacctacaaataaagacaatttaacttcttccttttcaattgatatggcttttatttctttttcttgcctaattgctctggtaggactttcagtactatgtttagtagaagtggggaaaatgggtgcccttgtcttgttccctattttaaaggaaaagctttcagctttccaccatggaatataatgttagctgtgggcttctcatatatagccttattgtgttgaggcacattccttctacacctaatttttggacagttttttttttttatcatgaaagcatgttgcactttgtgaaattctttttttgtatctattgagatgatcataagacttttatccttctgctaatgtggtatatcacatttattgatttgtgtatgttgaactatctttgcagtaaggaaataaggaaattcagtggggaatgggttgcgaaggtgggggtaggtgaatctatgttcctcagaaggaaaataatatagcattatggtatgttaacaatgttcccctgaagtgtagaggactcatttttcattgtatatgcctttgtactatttgaatggttttccttctgcaagtattgctttgggaaaaaaaaaagaaacacttaaaaatcaacttttacaaaaccaaactaattcttttttgctatggtttaaatatgtatgtcccttcagaattcatattgggacttatctcccaaggtgatggtattaagagataaggccccttgggaggggattaggcattgagggctctgccctcagggatggtattagtgcccttataaaagggtttgaggaagagtttgcctcttttgcccttctacttcttctgctatgtgaggacacagcatttttcccctttgctttccttctatgtgaggacacagcaacaaggcaccacctttgaagcaaagaatagccctcactggatactgaatctgctggtgccttggtcttgatttcccagcctctagaactgtgagaaacaaatttctgttccttataaattacccactctaaggtattttgttgtggtagcataaacgaactaagacaccttcccactcttctgctggtgctggtgacaggtgacatttactaaggtgagaaatctggtagatactctggactccctcctcttatttacccctcaaatctgtctaatcaggcaccaagacttattgattctacctcctagactatataattctcaaatctgcccctccactctatccctgaatcactttaactatagcattcattttgtaactggttgacctgcctcttttctccctgcaaaatgccaatgaatacatcttttcagagtgcaaatctggtcctgccactctcatgcttaaaattcttcactggcttcctagtacttatgggaaaagtccaaattcattagcttggcagcctagaccttccttgttcttaaccactattctaacctccctcctctacaggtacaggtagagggataggaagggaagatgatgaacctgaaattgataataaaagggaaagcctcccagaaatccttcatgaccaagaagagtgctgagggccaggagagaacttaggacaaagaaaaaccatgaattagccatggggagatctggagaagcagtccgcaggatactgcatccatgttggggagcagaggagtctacaaggaatgtgaatgcacagcattcaggcaggaatgctttgatgctggggacatttcttatggaacactgaaggagcatgaaacttgaggtattctgacatgcataatacagaatatataatgtctactaacagtctgcatccagggggaaatccaaattgagatctggttgtcaaggaagggtagaaattcactcagatgaaaggtacttctagagaaggaatagcatattaaaatcatggaaatgaaaggggaacaatggtgtcctgagggtaggatatatgaggaagagaagtggtgaacagtaaggccagacaggcaaactgggccagaacatggagaatagtaaaatcagattcacattttggaaagatgtgtccattggcattttgtagggagaaaagatgcaggtggatcagagaggaaatgaacactatagtccaagtgatgtataatgcagggatagagtagaggggcaagtttgagaaatgtctggtctaggaggtaaaatcagttagtcttggtagctgatgagacagatgtgagggataaataagagggagtatacagtgtctattagatttttcactctagtttatgattcagcctgtcgctagcatcagcagaagagtggggaggagaattagttcggttttagaaaaattgcagtttttaagtatttttaaattatttaaagcaatacttgtagaaggaaaaccattcacatagtacaaaggcatatacaatgaaaaaggagtgccccatactccaggggaaaccacttttaacagtttgttgtttatccctgagcagcaatatggcagagtgtgaagaacataagctctagaacaagactgtctgtatttgaatctaccatttccagctgtatgtccttgggctagttatttaacctctctgcctcacttacattatctctaaaatgggaattataataatgggacacagaaaaggcaggttataatactgcttggaaccttgccgtttgtgcttaacgatatatactggagataattccgtatccacatatacttttcttaaataaattttaaataactgaatagtatttcaccaagtgaactttttatagtttatttagcctttactcaagtaatgaatactgaagttgcttttgctaagacaaataatgttgtgattaatacctttttacatgtcttcacacacatacatgattatatattttatataaagtcctacaagtggaactataggtcaaaaagtacatcaatgtttaattgtgataaaatatactaagatccaaagaggttatgctaatttatacttccaacagtgtgtcagagcagtgctttacgaagtttcatatacctacaagtcacctggggatctgattaacaggcagattctgatttagtagatctggggtggagctgaatttctaaaaagctctcagttgatgcagatgctgctgatccaaggaccacactttgagtagcaaggtataagagcacatgtatttctccacatgcctgccccccaaaaaatgtacattaaacgctctgatttttcccattctgataggtgaaagttacatcttattgcttaaattaatctatactgctttaattgtaagtgttgagcttctctctctctctctctctccctccctccctccctccctctctctccctccctccctccctccctcccttcctccctccctccctctctctccctctctctctccctcttcccctctccatctctgagttagggtcttgcactgttgcccaggctggagtgcaggggcgtgatcacggctcactgcagacttaaactctggctcaagtgatgctctcgcctcagccttctctgagtagctgggactacagggcgtgcaccaccatacctggctaatttttagactttttgtcaagacagggtctcactatgtttctcaggcttgtcttgaactcctggtcacaagcaatcctcctgctttggctacccaaaatgttggaattacaggcatgagacactgtgccaacagagtatctttcatttgtttttataagcccactttctttttgtctgaactgcctgttcaggttcttttttccttttttgaatggtttgttggcattttcctgttattctcaagagctctttatatattatatattaagggaaccagcctcttgccatatcagatgcaaaaccttttccccagtttttttctttggattttatttttgtatttttcgggtgctttaaatttcaactttcgtgttgtcagatttaacaattttctcttttatggcttccaggtttttttgtttggttggttgttttttgtttttgtttttgtttgagacagggtctcattctatcgcccaggctggagtgcagtggtgcgatctccactcactgcaacctctgcctccaggattcaagtgattctcatgggattacaggcgtccaacaccacgcctggctaatttttgtattttttgtagagacggggttttgccatgttgcctaggctggtctcgaattcctgagctcgggtaatctgcccgcctcggcctcccaaagtgctgggaatacaggcatgagccaccgcacccggccagcacccaggttttgtgttttgcttagaaagacttttcttatttaaagataagatcatatactaaaagttatatactaaacaattgtctttgaatcatggttagacttcattacggtttactgatcagtctattcatgtgcttagtaccaaagtattttaattactgtaattttataatatgttttaacaggactagctgctttgtcttttattcctcttttattcagacctttcctgactagtcttacatatgtacttcagaatcagtttgggcatgttggattgtaatgcgtctggaggacaactccgtgtgtagaaatttaacatgcagttgaaaatgataatctggaatctgggcatgtgttcttccctagatatagaaatctgggagtcatcagtggtacctgaagcccctcaataaaagttcatagaataagaaaatgaggctgagatagaactctaggttagtggttctcaaaattcagtccccacacccgcagcatcagcattatctgagaacttcttgagctcctactagatcagaaactctggagacaggggaggagcagtatgttctttaatataaactctccagggaaatttaacgtatgttcaaatctgagaactactgttctagggtatatctgtggataagacaaattaaggaaaaagagctcaagataactagtagtaggaaaacaaggaaaaagaagtgttatgcgtcaggcgtggtggctcacacctgtaatcccagcactttgggaggccaaggtgggcggatcatgaggtcaggagttcgagaccagtctggccaacatagtgaaagcccgtctctgctaaaaatataaaaaaattagccaggtgtggtggggtgtgcctgtaatcccagctacttgggaggctgaggcaggagaatcacgtgaacctgggaggcagaggttgcagtgagtggagatcgcaccattgcactccagcctaggtgacagtgtgagactccatctcaaaaaaaaaaaagtgttatgataataaaagaaaacaaatttctagaaagtgctcaacagtgcccaaagctgcaatgatgaaacaaaataatatttattaagcaactactatttccaaagggcttatgtatatcagctcatttactcatgtaataaagtaaatatcattatccccattttacagaaaaggaaactgtgattaagtaacttaccaaaggtcatctagcttatatgtgatttgacaccagttctaccatataataatggcttaaaaacttactgaaaaattgcacattagaaaaggagaagaaactacgctccttggattttttttcaatctggaagacattaattcaccttggaaccatacagaggacagtggcatagtagtggtaggagtagaaggcagactgtagtgaggaaatgggaggtgagaaaatagagccaatgtctaagatgtttggctgtgaaggaaaagaaattggtagttggatgagggtaaaggttaagggcagattatgtttttaggatgaagagaccacctgcaaatatttatgtagaatttagattaatttagattagaaatttcattctaaggctccaggacaatctctagtcctgacctctcacttaaataccacaccagttctacctactccctacaactgcccactggctttctatatcttctatcaccccaaactaaaaacaacaaaaaccaaacaaaaattgatgccaagcctagctctttctatttttgttttgtttgttcattttaaatccttaaaggtctgactggctcaaacctggtaatcattgtgtactcctcctcttcttcagcctttatactgaattagtcaccaagtgctggctttgaaatatcttcacctattaacttgtcctgtctattcctactgtcactgctccctgtactacataagcaattgtgtagcatgagctccttacatccaatccaacccacaccaattttccacaaattccaatctcatacttattcatctgcttgcaatcctgcagtggttccccatggcctactaagtaaagcttgctttttctgggccttctatagattgttcacatttatctctcactgatcccctatataaatcttaagttggatggacctcctttatgtttcccaaaactacgtttctttccatcccttttttatgcattcctatgaactatttaggaattaagcaaagctccccctcttgtttgcaagcatagtgttatgttttcttcctctaatcttcaaaatcacttgctgctggcatcactcattttgataaccacgtacttccctgctcaagcattttgcctatgtatgtcttatctctctcaactagagtacagggctagagcatactccttctatgatcaccaccacattgcttaacatacatgctcagcactcaaaaatatttgttaaatcaatgaaattgtatcatgagaccttgccatttgaagagatcattggtgaattaattttggaaaatgcctttttaaaaaactctcaaatgccatattaagaacaacaatacacattcactgactatgtacccagtatcaggtactttctcttgaagtacctatttaattcttaccagatccctgtcgggtgaaggttattactctgaaaccataaagagaagactatgacatgtttaaagacttgcccagtatttctactacttctacagagtactcacagcctgcattcaaaacccccaagtccattgctctattctccacaacacagattttttctttcatttttattttttaaacaggatcatattgttcttacttgaattaaaaagattatttttctgtacttttgatatgaaaattctaattaagaaaataggtaaataatgagtatatttttatctcaggtttagtgtctaattacagtttctgtcactaatgagagaaagtacctttgtgtccccaaagtaaacttgtaccataatgcaaagggagatgagatgcagctgggtgttgcattaacattcataattatgcatcatatgttccagaaatgaattgttgtttgacagcaagggaaatgacaatagtaagaattatagcaaaagcacataaggttaatcaacatataatcgactctcaaatatgcacattttgcatgttttcttttattggtgtttatgatttactatttagaaacaactgtaaattaatctactagaatatatttccctattaaagatgcctgaattgaaaacatgcacatataaagtgaatacatttttaatgacacatagtagatatattacttaagggagattttgctccacaaatgcaataacctacacataatgaggtgttctccagcaatacttggtctaaaacacacaacacaccacaccacacacaccacacagacacacacacacacacacacacacactttggggacaatttaaacctattgggagaaaaagactagattaaaaagacatactgaaaagacacttttcagcatctcctaatgcatacattattaaacatagcataccccaaggaaacaggaggaatgcagaatacaaatgacatttttccactgactgagacctagcttcaaatcagaaaagaggatgccttcacccaacagatggctactaatgtcttaacgttaggagccaacaatcatcactttagttgcaagcagacccacacctagaaccttaaccctcatccaatcaaagagctaattaactcagtttattcttctgtgaagactggtgagcatctcaggtcgaggcaaagttaaagcctgggtaacttagaaatcctcaattatcctctcagatcaatttacaatttctttttctctgggctttactggggtgtcaaggttactactgaggataacacagggtgaggcaagggagaaagcatgcacaacttgatttttaaactcaaataaggatttctgaagaacccagtcaaaatatttcatttaaagcctctgaaaataccgctgagacagaggtaggtaggtacatcagtaggaaccaattgaggtgctacagagagcaaactagatatgagcaaactagatatgaagtcagatagatctggctgtgagacagtggacatgtcagttacttcatttcttcgtacctcagtctccttatctgtaatgtggggatgtatttatccctacacctcataagagagctgtgccaattaaatgacatgatgcatttgttagctgctagcactgtatttcacccaccgtatgtgctgggatagagggacagaactaacatttacggagtgtctattaaatctgaaagtaatcatggttctggccaagcctctaagttaggtgggaaggcatcatggaagaactcttcattctggattgaaatccctaaggataattttgtttatcttttcctggtcttaatattttcagaccaactgttgggccaaggactgatatggcactatcacagtgagctgtagaattacgatactcctaatgaatggaattctccaaaactcagccccgtttatacagggaaaatagatgggatctggagtcaaacacagagactgaatttgagttccagctctgacacttactagctttgtggtcttagacaactgacatgtccatttgagccttggtttgctatcactattgtattccatgatggcatgaggtctcaggccaagcaagctactcagatcctgggatacaacacacaggcaacacagagctactttcccagtctagctgggacaaaccaatggtcattgcaagcttttaccctgatgagttatggggaggggaaaagaaattatttttatggtgataacttactgtggcgtgaaaggggcctctagcaattcttcttgttctaggaaattcatcataatagtgattctgaatcacatattatagaccagccatactcttcatcacttcatgagcagcctctcctactcatccttaaacttttcctttactcaactccaggcctttcccaggaaatagaaagtagaaaagaatcatacacaggtacacatactgagagagagaggaggtggggaggcaggaatataacaagagaaacatttcttaatctcatacaaaatgcatacaccaaaacaagtttttaatttttgttcaaaatattccattcttttggaagggccatgggtactttaagaaatatctttctgaagtgcaaagagggaaaacctcaggtaagtaaccttcaatgtgtgtaaatttaaatcaagcctttttttatgactgagagaagggcaggtgatgttctactctttcccccagaggaaaaaaaaaactaccatgtataacttctcaaagactattcaaaggcattcattaactttatacttaacaaaattgagggatattctacaccttcatcacagaaaaaaggaagaatatatctctgcattaggagccagagacaatcatttttagctgaacaagggtgccagaacagccaacccatgctttccctttgattagctggaaagcaatcaatgcactcttgttagattggagctctcactcaggatagaaactggcctgatgtccaaaaagtcggcagttcagagactaatccccagaagggatcttgacatttgcgctaagatccagagttggcatgcttatcagaacccaagtttaagactgaggcttgaagttgttaagtaatagactggtgaggcatattcaacatcttcaaaattcacacgtttatttcatcagctgaaacaaacagcttaggtacttaaggtttgcttcatttagctgttttactaaagatattgggttttaaataaatatatttatttaactttaaaatttattaaagatatggggaggtaatacttataaatcttaggattgggggcaaaaacattatttattgagacttctgcttctgggaaaatggagatgaactttctcccattcctttcactaatataactagaacccttggacattatgtataaaacaaacataagatgactctcagctgactgcctctgataccattcattaggagaaaatatttgcaaaacacatttctgacaaaggactagtatctagaacatgaaaagaaatttcaaaacttaggagtaaaaaaaatctagttagaagggtgttaatgtaatgaaaatgatttctattacattaagaaggcaaaccagtgagggaccttgagttccaaggaatgacacagtgataaggtctctggcttttctttttaccttctatagcccagatttggagctgagaagcaacaacctggaaatacttgtgggcacggaccaaatataagccccaataagagcctgctctcactatccagaggactgggagaggggtagacaccaagacataaaacttttagataataactgctctactccagtcaaacagcacaggaaaactgtggccccagccaccctcatgccaatgaaggctgagtggggagcctagacttccactctgactaggctattaataaggtgtcgcaaatctcctcctccaggtgttggtaggaaagaccaaatacagagacaggactttcatccatgccaggtgataacaagtctcctactcatgatgttaatggagaacacatggggagcataggcatccgctccccgcttggcggtaacaaggagcccctcctcccagctgaggtggtgttcagaggcggcctagtggggtgttagaacctccaccactgcccagcagtaagcaagccactccccttctctgtggtgtcagaggcactcccagcaagggagatatcagtgaaagcctagcagaaacaagcagcctccctcctcaggtgtcaatagaggccaagtggagagcctggactttctacctccacatggcagtaatatggcagcaacccccatcacttgccagagtggtgtcagaggaagccagctaaaacaagcttaaatatgattcagagtctcaaaacataatatcctaaatatccagatttcaatgaaaaaatcattcatcatgctggaaccaggaagatctcaaactgaatgaaagagagataatcatgagacaccacaagatcacagaaatgttagaatgatatgataaagcacccattataaaaatgcttcaatgagtaatgacagacatgcatgaaacaaatgaaaaaacagaaagacttacaaagaattagcaagtcttggcaaagatgtagaatatataaagaagaaccaactggaaatcttagaacttaaaaatacaatattcaaaataaaaaaacaaaatgaatacaggcataccttggagatattgctttgattccagaccactgcaataaagcaaatactgaaataaagtgagtaacatgaattgttttggtttctccatgcatataaaagttatgtttacactacactgtagtctattaagtgtagaatagcatcatgcctaaaaacaatgtacaaaccttgatgaaagaatactttattgctaaaaaatgttaatgatcatctgcgtcttcagtgagtcataatctttttgctggtggaaggtcttgccttgatgttgatggctactggcttctcagggtgatggttgctgaagattggagtaggtgtggcaatttcataaaataagacaacaacaaagtttgctgcatcaattgacccttccttccctgagagatttctctgtagtatgccatgctgtttgacagcatttaccgacagtaggatttccctctcctctctcctctcttctctttcagagaattgctctgtcacccaggctggagtgcagtggcgtgatcacagcttactgcggtctctacctccctgggctcaagcaatcctcccacctcagtctcttgagtagctgggacttcagacatgccaccacacccaactaaattttttttttgtagagttggggtttcactatgtttcccaggctgatcttgaactcctgggatcaagcaatccacatgccttggcctcccaaagtgctgggattacaggcgtgagccaccgtgcctggcctgacttctttcaaaattggagtcaatcctctcaaaccctgccactattttatcaactaagtttgttgaatatcctaaatcccttgttgtcatttcaacattgttcacagtatcttcaccaggagtagattccatctcaagaaaccactttctttgctcacacataagaagcaactccttgtctgttaaggttttatgagatggcagcaattcagtcacatcttcaggttccacttctaattctagtactcttgctattcctaccacctttgcagttacttcttccacagaagtcttgaacccctcaaagtcatttatgaggggtagaatgaagttcttccaaactcctgctaatatggatattttgatctcctcccttgaatcatgaatattttaatgacatcaaaacggtgaatcccttccataagattttcaatttactttggccacattcatcagaggattgtctatggcagctatagccttacaaaatgcatttctttttttttctttttttattattattatactttaagttctggggtacatgtgcagaatgtgcaggtttgttacataggtacacatgagccatggtggtttgctgcatccatcaacctgtcatctacattaggtatttctcctgatgctatccctcccctagccccccaccctctgacaggcccctgtgtgtgatgttcccctccctgtgtccatgtgttctcattgttcaactctcacttgtgagtgagaacatatggtgttttgttttctgttcttgtgttagttttctgagaatgatggtttccagcttcatccatgtccctgcaaaggacatgaactcatccatttttatggctgcatagtattcaatggtgtatatgtgccacattttctttatccagtctatcattgataggcatttgggttggttccaagtctttgctattgtgaacagtgctgcaataaacatacgtgtacatgtgtctttgtagcagaatgatttataatcctttgggtatatacccagtaatcagatcactgggtcaaatgctatttctggttctagatccttaaggaattgccacactgtcttccacaatggttgaactaatttacactcccaccaacagtgtaaaagcattcctatttctccacatcctctccagcatctgttgtttcctgactttttaatgattgccatttgaactagcatgagatggcatctcattgtggttttgatttgcctttctctaatgaccagtgatggtgagcttttcttcatatgttttttggccacataaatgtcttcttttgaggagtgtctgttgatatctttcgcccactttttgataaataataagacttgaaagtcaaaattactccccaatctatgggctgcagaatggatgagttagcaggcatgaaaataacatgaacctccttgtacatatccatcagggtgcttgggtgatcaggtgcattgttaatgagcagtaatatttgaaaggaattttctgagcagtaattatcaacaatgggcttaaaatattcagtaaccctgctgtaaacagatgtgctgtcatccaggtttggttccatttatagagcacagacagagtagatttagtataattcttaagggccctaggatttttggaatggtaaatgatcaatgacttcaacttaaaagtcatcagctgcattagcccctaacaagagagtcagcctatcccatgaagttttaaattgaggcactgaattctcgtttttagctatgaaagtcctagatggcatcttcttccaatataaggctgtttggtctacattaaaaatctgttgttcagtgtagccaccttcgtcaatgatcttagctagatcttctggataatttgctgcagcttctacatcagcacttggtgcttccccttgcacttttatgttatagagacagcttctttccttaagcctcatgaaccaacctctgctagcttcaaacttttcttctgcagcttcctcagcattctcagccttcatggaattgaagaaagttcaagcctttttctgaattagggtttggctaagggaatgttgtggctggtttgctcttctatgcagaccactgaaactttctctatatcagcaataaggctgtttcactttttttataattcatgtgttcactggagtagcacttttaatttcctttaagaactttcctttgcattcacaacttggctgttcggtgcaagaggcctggctttcagcccatcttggcttttcacatgccttcctcactaagcttaagcatttctaactttttatttaaagggagagctatgtgacacttcctttcacttgaagactcagagggcattgtagggttattaattggtataatttcaatgttgtgtctcagggaatagggaggtctgaggagagggagagtgatagaggaatggcctgtcggtacacacgacatttatcaattcagtttgccatcaatttgacagtttgacatcaattcagtttgccatcttatatgggcacagtttgtggtgccccaaacaattacaatagtaccatcaaaaaatcattgattacagaccatcataacaaatatgatagtaatgaaaaagtttgaaatattgtgagaattacatgtgacacagagacatgaagtgagaacatgctattggaaaaatggtgccaatagacttgcttgacacaggttgccacaaaccttcaatttgtaaaaaccataattatctgcaaagtgcaataaagcaaagtgcaataaaatgaggtatgcctgtaatctcaacagtagaatggagaagacaaaagaatcagtacagttgaagatagaaaaatataaattacccaatacgaacaacagaaagaaaatagactgaaaaaataaacagagcctcagggatctttgggaccatgccaaaagatctaacattcatagtactgaagtactagaaggagagaagcagagcaagactaaaaatatacttgaacaaataatacctaaaacttccccaaatttggcaaaagacataaacctgaagattcaagaaggtaagaaaatcccaacaggataaacccaaagaaattcataccaagacacatcttagtcaaaagtctgaaagctaaagacaaacaaaaaaatcttgaaagcagagagaaagaagtgacacattactgatatgtgaaaaataatttgaatgacatcatatttctcatcagaaatcaatggagccagaggaagtggcacaatatttttttcaactactgaaagaaaagaactttcaatccagaatcctatgtcaagagaaaatatccttcaggaatgaaggagtcatcaggacattctcagatgaggcaaaactaacagcattcaccactggtggacctattttaaaagtacggctaaaggaagttctgtaaatggaaaggaaatgacaaaagaaggattcctggaatattaggaaagaagaaatgacatagaaaatatgtatgtatgtatatgggtaaataaaatagatttcctttttctcttgaattatctaagttatgtttgatggtgaaagcaaaaattataacattgtctgatgtggttctaaatgtatgtaaaggaaatatttaagataattttattgtaaaaagagaagcataaagagatgtaaagaaaggtaaagttactatacttcaaactggtaaaatgacaatatcaataaactgtgatacatgatgtatatctaatacctatagcaaccactaaaaaatcaatatgaagagatatactcaaaatctctaaagataaatcaaaatgggattctaattaatgtttaagtaacctactgtaaggcagagaaaaaagaaagtaaagaaagtaaaaaagagaacaaagagaaaacaaaacaagatttaagccctaacatattaataagtatgtgaaatgtaagtggtctaaacacatcaatgaaaagacagagactggcagagtgcataaaaacacatgattcaactatatgctgtcaacagtaattcacttcaaataatataagcaggttgaaagtacaaagacaaaaaatatactatgtagatgtgaatgaaaggaaagagagaatggctatattaatagcagataaagtaagcaaccaaagaaataaatggcattcagatttggaaaggataaaataaaactgtcgctttttggagataacatatgttgaaaatcccaaagaatctaaaactaacaaaatcaatcagtcaaacaaacaaaacaagttcagcaagtacgaagcatacaagatcaacataccaaaagcaatcacatttctgtatacaaataatagacatgtgaaaacaaataaaaaacaataccatttacagttgctgcaaaaaaatgaaatgcttagatgtaaatctaacagaacatgtatagggtatgcatgctaaaaaccacataatgctgaaaaaagaaaaaaatccaaatgaataggaagacacactgtgttcatggattagaagacgcaatatagtaaacatgttaatcctctctaaatgtttatacatatttaatgcagttcctatcaaaatctcatcaagatattttcttgatatagacacaattgttccagaaaggcagagcaactaggataaagcaattgtgaaaaagaagaataaagtaagaatcaatatacccaatttcaagactttgataactatagcagtcaagactgtatggtattggtagagggtcagacacatatatcaatggaatcgaatagaaaacacagaaataggcccacacaaatatgccaaacttatttttgacaaagttgcaaaagcaattcaatggaaaaaaagatagccttttcaacatatggtgctgtaacaatgagacaacaacaggcctaaaaacaaacctcgacctaagtctgatacttaaacatgcacacaaaacctcagaatggatcatagacttaatgtagaggtaatgtaaatgtaaaactataaatattttagaaaaaaataggagaaaaaatttgggatctaggacattgaaaatagtttttagacttgacaccaaaagtatatattaattcatcaaaggaaaaaccgataaattggatttgagttacatcattcattccttcattaattgttaacatagactatcatgttgtggatactgagactttacagataattaaaatgcagcccctgtcttcaaggaaatcatagtttagtagagaaaagcaatatctaaactaacagttatgatgagatgtggttaagtgcacagaggacggagctctcctgtagggatgaggaacagtttgtaatacatagcagaaacctttaacaatgagcagagacttagcaggtaaaggagtgggacactattctaagcaaagagaacagtatctgcaaaggcagagacatgagaggacactgtattcagggaacggttaatatgttcaaggaggctaaatgtatgagatttgtccatacgttgtcatcatttagagaggggaacaacacacactggggccttttggaaggtggagggtgggaggagggagagatcaacaaaaataactaatgagtactaggcttaatatctaggtgatgaaataatctgtataacaaacccccatgacacaagtttacctattaactctttacctatgtaacaaaccttcacttgtacccctgaacttacaataaaagttttgaaaaatgagatttgaatgaatacatatctgaggtagaaccaacaggatttggtaactgatttgataaaggtgaagtgggtagctgagagaagaggggatcaagatgcttcttgaattcctactttaaaggactaggaccattaaatgtgatcaggaacaggaaaggaggagagggcattcttgtttctggatggggggaaagtattaaaacatattgagtttgaggtacctgtgtttcttggcaaaaatgtcctccagacaactggaaatatgaagttagtattgagaaaatagttctggactagagatgtaaatgtgtgaggcatcagtattcaaatagttgatgctatagtagtaaattatgttacatactgaaagggcacactgagaagctgggtgtctgagagacaaaaaaaaattgatagagcaaagtccaatgttcctttttgactatttgccattcggtcttcacaaaactagtttagattcccctcaatgcattaacatttagagaactctggcttgaataagacaaagagatgaaaaggctgccatttctcagccattgctgccaactcccttctcttctatctccacatagcatctctggggaggtaaggatctgctgaagtcagtaaagaaaattccatagctttctttggtgatttattactgactgcagaaagtgatttagttctctagaagacctagctaaaatccttcctgctacaaatgatactgtttcttcatgtgctgtcttaatggaaaaagaagacagttagataccctattgtgtgtatcatggaattatgttttccagtctggacagcatggggaagtagatttttcaagacaaataaagtggctgatgggaggccctagggttgacagggaaaaagatgtggataagattatgggattcaattcctggtattctagaaaagtagttttttttttttctagtccttgaaagcagttattaaatcacttcttcttgtcttacaaaacaaatatatgaagaatcaaatacacagcttatttattttgcaaggcaaaactcccctatggacattaaattggctgtgaaatgagttaagtcggcaattttgctttggttttgttttgtttttgtgtttgaaaccatccatggcaagtggctatttctaagggcttgaaaattttatcttctctgggttgaataatcttgattctttcacaaagccttcacttgaatgacttttctatccattaattattttatatcacttccttgattgctcaccaaattctttgtacccatctttagctattatgataggatcactttaactctctgatcaaaaactgcgtttaaatattgttcaaaacattctgttctgtgcaagggatataagcccttgaaaaaaacatttcagagaaaaaaaaagtgtcaggccctgttgttaaaggaagtgagctgtaccggaatattaatcaagtccagttattgtatccaaattaaactggtgtctcttaattccagcttgaaaagcagcaaagtggaaggaagaaaagtaatgcaaaggataaaaatagaaaatatttcctgcttaaagaaagagagaaacgggatttttacatacatagtggcatcacttccttaatgaagctattcccttttctataaattctgtctggtgtggaaggacaaagaatggtggaaggaaatctgaaagcaaagatgttgaacaggtaaagttggagtttcccactagttagctccaatagtcaaggctaggggaacatatcaatggccaacacagtatgaattatagttaatccctgagaatggcagacttgagtattttggatactaagggaggcccaaggatgaaaacatgcttctagagaacattttcattttatttgaatttaaattaagatttgggatgagctgataaaaggcaaagtgaaggagtatcatacctggtagtgccttagctgtttattgtttttaaaaattgttctacaattgccagtggttttggttaatgtcaatctaagatatctcaacaccgatatctaggatttttaatagacaaaaggcataattttctctcttcctaatgtggtaaaacataaagtttgatttgactggtgagattgagtctagaaaaataaaggggaaaagacagctaatacttctaaagatgctaaattctaagtatctgcatgctctcatttcatcctcagtagaaatcagtgaaaaagaggtgagaaaatggacccagagatattaaggcagacgtccaacttatcagtccactgctaatcttatactggtggtcctaggtgttcttcccaaagtgacattcatgcattcattcattgactatttgtttattcatcaaatactgtattccaggctctgaagccacgtcctggagattaatggtgaaaaacacaaggcctagctttatggaaacttattggttcctgaccaattctccaagttttaggtaagtctgagttctaagtcaacctattgacttcccattctacattctgttatctgcctaatcagtgggtattcttttggttgtatggctgtgatcaactcaagtatgagtcattcaaaaggggaaaaacaaaatgaccaacctatcttttctctgacacaatcaaccaaattagcgtaggaaaaagttattaagtcacatccattccatcctgggaacagagcaaaaccactccttgtattatgctacattatttttcaacaaaattgtcctgtataattgtaaataattataaatgactcagtggcaaagtttccaccatttcctctcaaaggttagcccacgctccagtaatttttagcatcaagatggtttctctgatagtcagcctaaacagcccttgtcctgatttcatctaattaagctctgatctaccctgatctcattctatgcaattcctcttttgctgctgtatttatatccttcaaatatagctatatgcctatcataacaaattctctcccctctccaccatggctgacctaatcttaagctaaactcagcagacaaaactgcaaccccaccataacttctagccatctcagtatttcctaccctatgcagaaaacaccaactaatttcttgcagttctgaggtcagaccttccaggtctcttcctatacattgggcagtggggcaggtgtccagagaccacaaattgcatttcaatgacatcctgtcacctccactcttctacttctctagggtacagaagtacttcctcagtgatttttttctaaccacatgttttgagggtctggcagaacagatccaattcagaagaacatcttagaagattttgttgaatctatctgggtgcagaacttattccttcactctcacactcaacttttgttgaaaactagcagtgtcataccctagtgaatctgacatgttctctctcaaggaattcacagtctaatacaggagataaataggtccctctccccaatttaccccctgccaccctccttttctaaagaaaatacaattcctcatctcccattcactcttcactgaaattgggcctctgctcataatgttttaataaagccttttctgccaaagtcaaccagtaacctctgaattagcaaactcaatagtcttttttcaatattcatccaactaaaatgcaagaatattcagcactattgattgttggactgctttttcttgaaatcctctccctgtccttggtttccatgacaccactctcccacgtctcctcctacatttctgagtgccctttctttctctcctttacaccactttctccctttcctctcagcagacagcttctccttatagttgatttaaaaagataagcattgagaaaagaacttcctcttctttccaccgctgcatcaccaacctaccttgccttatctcctcttaatatgggtgaattatccttatccttaacaaagttcaactccgcacttctgctctgatcttcccaaggaccttgctgctgcaattatatttgtctatgctgtccatttcttttctataccatcaatttctcccttgctactgaattatttccattagcagtcagatatttaatatttgtgattttaaaatttccccttatgtttaatatacttttattgaatgtgtccctttaacatatatattgttttgtgtgcatgtatttttatagatacataataattgtacatactttgggggtacgtgatattgtgatacatgcaaataatacataatgatcaaatcagagtaattggaatatccatcacccaaacatttatcatttcttcatgttaagaatattccaaatcttctcttaaagctattttgaaatatacaataagttactgataactatagtcaccctactgtgctatcagacactggaacttattcctttcttttaaaaattaattttattaaccgacaaaaatcaccatatatttatcccaattgcctctctagctaacactcttatttttctatactccttttacaactaaactcatagaaagacttactaccttcacttcttcactgtccattcttttatgaaacaatccattcaggcttttgtctctgggttgccaatgactttcatgttgccaaaatcaatagtcaattctcagaatcaatgtctcatcaacatttgacacagctgagtactccctctttcttgaatcagtttcttcacttgcattgtgggataccactctcatttggtttttctcctacctcactggccacttctcctcagattattctttgggtttttcttcatctgccctatctttaaatatcggagtatcccagggctcaatacaaggacctctcctctttgctgcctacacttaaaaaaattaaaggtaactttattttatcaagatttaatttccttttaatgtccatggttttagctcctgccaaaattagaggctgcctcctcaactggtccaacttaggcttaaaaatattttttaccttgaaataatttaaaatgtatgatagagttgtaagaacagtacaaggaattcctgtgtagcctttatctagattcaccaactgattacattttgtcacatttgctttttcactccctctctctctagacatataaattaatatgcatgtatgtatttactcatctatttcagagagagtttcagacctcatgcccctttacctctaaatacttcagtttgtctttcctaaggagagaaattatcttatacaattacagtactattatcaaattcaggaatttttatattaataccattttataatatacttaacccattaatgttctcacctggtgtcaaagctttatcagagggtgactccaaaatttaaatatttaaccttgacctattttctcaattctagactcttctacctaatttcttagttaacattagcatgtagctgtccaatagacatgtcattacatttacaaagttaatgtgtataaaaccaagctacttctttcctacttcttcccgttacccataaaacttgtttctcctccagtctttctcgcctcagtaaatggtaccacccagttattcaggtcaaaacccaaggaagcatttagtccttgcctacccattccctaccacagccctgcccaattcacacttgatccatcagcaagtcctccaaaacaaatcctaaatctaacaactttttaccatctccatcactaaaatccaaatccgactcattaccatctcttgcttgaattattccaagtagcctcctaacaagttttcctgcttcctctctgccccctacagtctgtttcccatacagcagccacggtgatcatctatcaatccaaaactaatcataccactgttctgcttagaactctctaacagcttccttctgcaaatagaatacatttgtacacatttgaacttcttaccagagcctacaaggccctgtgtgattatatgcctggcttcctctcctttcatgcttcctttgcttaccacactccagttttaaagctttctttctgacccttgaatacatcatgtatttttccatttaagagctcttgtacttgatattcttctggctggaatgctcttctccccagatctttatatggctgcctctttcttatcatttaactcttggttcaaatatcttcatagtggtcttccctgaatgagctaaagtctcccctgcccctgctgctcctaccacacccacatttagtcattttatatgcctttgcattgctttattttcctttatagcacttaccagtaatggatataacatgtttgcgtatttgtgattattgtctacttctcccattcctgttagaatatcagctccatgagggaaaaggctattttgttcactgatatacccccagttcctaaaatagtacccgacacagaccatggctctagtaaatatttgttagatgaatgaatgaatggttcccctctttgcatttagctcacatatgtcccccagaatctggtccctgatcgtcttcttttcctccctacattactgtttctggaagatcccatccatcccaatggcttcaattactatcgacccaaataactttcaatttaattattgagtcatttttttctttgtgtacccaagaaccatagttacaactgtctactcgtcctttatatttggacgtcttacagatgcttcaaattccacatgtctaaaactagctcattattttgtttctttttgatataaagcatataaagtacctagtcaaatgctcagtgtctaagaggcactcaataaatgctagttcttataaatagcatttgtaactagtatcttttaactcaatccaatttggcaagaaaccttgcactcatctttgactctatctctttcctttgctgaatccactatctcagctttcaagtatttggatgcctgacaacccaatacccctaaaagtctcagcctctaatcctcactgcaataacccttactgcccttgcctggcatacattcattccattcaattagctattcaatgagtatcgagcatgtaaccctgctaagcactatgatcactatacttaagataggaggaaaaacaacacatggacactgcccaaaatttacaggggggaaatagacaagtaaacaggctgttacgattctagatagaggaaattaaagggtgttgtttatgggaggaagcttaatacagtctggggatatcaaccctaacacttcttagaagtgataaagcttaggtcaagtcttgagtgttgaataagagttagctaaacaaagaagaggaaggagcagtcatcattttgggaagaaggagcagaatgtgaaaaggcacagagatatgagagaatatgttgtagctggatgtgatggttaatactgagtgtcaacttgattggattgaaggatacaaagtattgatcctgggtgtgtctgtgtgggtgttgccaaaagaaattaacatttgagtcagtgggctggggaaggcagaaccacccttcatctggtgggcacaatctaatcagctgccagcaaatataaagcaggcagaaaaatgtgagaagcagagactggcctagcctcccagcctacatctttctgccatgctggatgcttcctgccctcgaacatcagactccaatttcttcagctttgggactcagactggctctccttgctcctcagcttgcagatggcctattgtgagaccttgtgatcatgtaagttaatacttaataagctcccctttatatatatgtgtgtgtgcatatatatatcctattagttctgtccctctagagaactctgacgaatacattggagaaatataagcagttgaatgtggccataacataaagtgcaggcttgtgtggagatggcagagataaacaggcgttctatttcaaggggcctgttcaccaaattaaggagtttggattttaacctgaacacaatagggaactttgaagggttttggtgagtaaagatttcatgatgagatttgcattttaaaagatgactctggttgcactgtggagaataaattcaggaggtagggagcatggtaaaactagaggtaggtaaacaaattgagagacttgcagtgagcaaacaagagagaagaagtttgagaaattttcagcatatataaaatggccaagacttgctcaattagatatagcaataaggagctgaaaaaactgggttcactgtgaattatttacctttatagaggcacacaggaggagaagcagattttatcagggtttggaggtagaagttaatgactttaacatatagagttttggagatacgtgtggggtataaaaatgaagatacctagaaagaagtggtataaatgggagtgaggtatgggatggagtgagagatttagaagtcttatttgctaaattaaatcatggaatgaattaaatcacccagaatgtacagtgttagaagagtagagaaacttgtgcagaacttcagagaatattaatacataaggggcaagtagaggaagaggaaccataaaaaaggaatagacaagagaaagcaaagaaaaaccaggggaagcatagtgtttctggagccaaaggaagataaaatttttagaagacaataatgttcaacaatgttaagtgctgatgagaagttgtactgagttgaatggtgcccctgcaaaattcatgtttacccagaacctttgaatgcaaccctgtttggagacagagcctttgcagatgtaattagttattatgaaatcatactggactaaggtaggacctaaatccaatgactggtgaccttacaagaaggccacatagacacagacacacagagacacaggggaaagggccatgtgaagatggaggcagaggttggagtgctatgtctacaagccaaggaatgcctagggttgctggtaaacaccagaagctaggaagaatcaaggaaggaccctcccttagagccttcagagagagcatggccctaccgacacttggatttcagacttccagtatcctgaactatgtaatctctgctattttaaggtacccagtctgtgtcactttgttgtgacatccctaggacactaatacagaggtgaagtaacacaggaaccaaaaggagttcattgcttttcaaaatagtttacctgtgaaaggaaaaaagagcacaatacctaaagatgactataggtctgggaaaggtgttttcaaaatgggagacttgagctggtttgtagacttaggggaaaaaactaggacaagagaagggtaacaggttgaaaatgcctgaaaaagggagagtggaaattaaaggagcaagatttctttaaaaagtggaggagaatgaggtccaggacacctgtgaaaaaattgggtatgtccaagtgaggaggtaaactcttttaagatatacccctttgggtttcagaaagataaggatagaaaaaagtcacgtagattcatctatacagggtcttaaatgctgggatgaagtatttagacttatttctgcaggcagttggagcttttttgagaaaggaaatgacatgagccaggctaagcacaatagagacctcataactcatgagatttacccaaagcacaattactgctgattgaaataaatacagagatgtactttaggaagattaatttggcagaagtgcagagaatgggttggagggcatccagacaagaggtaatgagtccctggcagtagcaggacgaaggaaaaggaaatagatgagatggatattagaaacactgcacagggagctcagaaaggacttggtgactgctgggaataaaagagggaatttaagtggattctactattgtgagcttgattgacaaggatgggaaagatgccatagactgaaatagagatattaggacactggagggggttggttgggtaagggttaatgtacaccttggaatggaagtctggagctcaggaagaagggaaagctgggaagagagatctggcagtctcctatatccaggagagaggtgaaacctttggaagtggataaattcataaaagatgaattggcagaggaaaaagttaaggcaaaggatagaatcacaaacttactttaggtacagaaaggagacatttcccccaagtatagaaaggcttcctagaggaggtagcaaatgtgaaacatcccagaaacagtggaaagaaaccttgactggtaagaagaagctgctggttctagtctagtctacctctgtcgctgtgtggccttaggaaagtcctttctcattctaatcctcaatcttctcacctataaaatgaggtcactgaatacggtgattacagaaacctcttttagctctagcagtacattttcctttgattgaagcttgactttggcctttgttttggcaagagaggtagataactttctagatcaagaaatagtatacaatggcaaagaggcacatttaagaaaagagaaatgaatgaattcagaactagtcattttcacaacttgagctatccaacctaatgatcattctgattgacaattattagggtactatgtgattgataataacacctggtctatgagttgtgtaatgaagtttttttgtttgtttgtttgttttgagacagagtctggctctgtcttccaggctggagtgcagtggcgtgagatctcggctcactgcaagctccgcctcccgggttcacgccattctcctgcgtctcagcctccgaagtagctgggactacaggcgcccaccaccatgcctggctaattttttttttgtatttttagtagagatggggtttcaccgtgttagccaggatggtcgcgatctcctgatctcgtgatccgcccgcctcggcctcccaaagtgctgggattacaggcgtgagtccccgcgcctggccggatgaagttttaaccagtattgtactgcctgctaaaatcagtactgaaggataagtactgccttccttttacttaggaaaaagaaaagagcagttaccaaatggctactctgtttcaggtactttcatatatttacctaaaaggtaatttacatgaaggcaagattttcttttaaatctgttttattaactgatatatcactaatacctaaaatagtgcttagcacatagttttcaatattgtttgaatgacttgaaaaatatatgtatatattttatatatacacatattttatatgtgtgtgtatataatgtcatttgatcattataacaaacttgcaaaagagacattagtgttcttatcatacggatgggaaaagaatgactaaaagaggttatataaacttactcaaagtcacacaacctgtaggggtcgtgccagagtcaaacacaacagatttataagctccatgtgggcagggaatgtgtctatgttattctccatggtatccccaacagctaactccgtatctagatggaagtagcatttaataaatatcttgtgaacagaaggaagcaggcaagcaaacacacacttgtgtgaacccatataccattcattttaccctgtaccaaccacatcattgcccaaattcaaaagaataattgaatctcaagaatccagcagtttgcctaccatgtttgttggcttaaatattctgtgatttttttattcattctcacttgtagactacgatggttctctttcagtctttttaagctttagagagagcctcaaggtcttctttttggagaatgctttataccaggggccagcaaacttagtctgtgaagggccaggtagtaaatattttaggttttgtagactatatagtgtctgttgcaactattcaactttgccattttggtgtcttttttttttttttttaaaaacagctatagacaacacatagatagatcagcatgcctgctccagttgcttttattccaataaaatgttaattggaaaactagttagcaggccagatttggccacagaccatagtttaccccacctctgttttatattattattttaatttttctctctcttgcctttccaggacttctctaacactgtgccaactgtaaacatcttcctatccctggtatattaatacatggtaggacaacttcagttttaacaagtttcaacagttgtaaccccttccatttaattatagatggcaggagtattatgacaacaacaaagacaggacagctagggaggctggcaggtggcctagacaaggctcaaagatatggcagttccttttcataatcttaatgctggtccaggatctagataccaggttcatataataaaaactagattttttgctttttgatcagtgtacccaaaattgatcagttatttaaaaacagtctttcaaatatccataatcataataaactgaatggaatgtcatatgccaatttaagtgaccacgagaaatataactatcaagaaaaccagttactcatagttcctacttccctacataaggatgtgtaaaaaaaaaaaactcctgagtccttcctatgtgtcatagagtgtactaggtgctgagaacgcaacaatgaacaagcagcccctgtcctcatggttctagtctaagggtcatttttttttcctctatagagccaaataaatattttaggctttttgtgtcacacagtctgccacaactcaattttgccattttagtatgaaagaagcatagatagtacataaatcaataggttccaataaaactttatttatggacacttacatttgagtttcatataatttcacatatcatgaaatacgattcttttttccaccaaccatttaaaatatatacatatatgtatgtatgtgtgtatatatatatcaaagagatatctataccccatatctattgcagcagtatccagctgagatataaaatcaatctaagtgttcaaaaacagatgaatggataaagaaaatgtggtatatatacacaatggagtgttattcagccataaaaagaatgaaatcctgtcatttgcagcaacatggaggacgttatgttaagtgaaataagccaggaacagaaagttgaacaccacatgttctcactcatatgtggaagctaaaaatattgatctcatagaagtaaagagtagaacagaggttactagagggtgagaaggtagggggaagggagggatatacagagatttgttaaataatacaaaatggcaaaattgagttgtggcagactgtgtgacacaaaaagcctaaaatatttatttggctctatagaggaaaaaaaatgacccttagactagaaccatgaggacaggggctgcttgttcattgttgcgttctcagcacctagtacactctatgacacataggaaggactcaggagtttttttttttacacatcctcatgtagggaagtaggaactatgagtaactggttttcttgatagttatatttttcgtggtcacttaaattggcatatgacattccattcagtttattatgattatggatatttgaaagactgtttttaaataactgatcaattttgggtacactgatcaaaaagcaaaaaatctagtttttattatatgaacctggtatctagatcctggaccagcattaagattaatgtattatatattttcaaataactagaagaaaggatattgaatgttcccaacataaagaaatgataaatgtttgagataatagatatgctaattactgtgatctgatcactatacattgcacattggaaaaccactatgtaccccataaatacgtactatgtatcagttaaaataaattaaaaaatggaagtgaaagaataacctggaggctgataaatgacattggtaaggaaatgagagtgataatccctgcttgtctgagcttcaaaaatgaagggaatcttacatgagggtggaggaatgatggttcggaagttgtctatggagagcatggctaaaccagaatatgtcaatatactgtacattcaattgtatcttgcctttttgtaagaaaaagtaatacagtaccctaagactttacccacatcatcaaaaattacttgtgttcattttctctgtctgtacatttttgtaatttcctccatacacaacctctttctttcatgcatatttcttaagggcattcctgattgcttatgagtttgttcccattacgaatgacataaatttctccatatagcttctaattgattactgtggtctattgttacctttaaatttgttactctttgacttctcctttgaactggttgtaacactttacgttttcctcattaatgagtgaaatacaatctttaacatgttcattttttgtctacgtaagaatcaaaattttgccttttaaaaattattttaatacttgtaatgaattgttactgtcctatactattgaattagatttcatagaattccatgtatatattttgcatctaaattcacaaattggatagaatattctttcttagagcagtctgtcaggttttggtatcagagtaatgctagcttcaaaaacaatgtgaataattctgcaacattttcaatactataacatacttatagaattaaacgtggctatttctagaaaatttgaaggaattcacagataaaaatatctgtcccttaaagccctaaagtatttttagatgtccctaaagtatttttggaagtttctctttgataattgttttcgaagtttctactgttacatgtccatttagttttcaacttctcaataatttctggcatttaatattttattagatatttttaagttctctgagattttcaaatatattaaggtacaattatagtagtgcgcctttaatttaaaaaatctttctttgttgttgtattccatttgtcatttaaattttattggtaattcatctttgttttcttgattaaatttgctaaaggcttatctatttaattcatccctctgaaaagaaacctagtccttggtttcatattatattgaattattagtcatttaatttcattcttcatttttaataataaaatatttaaggttatgaatttacttctgaatattctcaaagttttggtaagtcatgatctcatttttattattgtttgttagtctgctagtgtttctttgtgctaatattcacatataaatgtgatctaaaatattcaagtaattgaagactttaaaatttgtttttaaattgtaaacattgtacattatcatcagatatttctactcttaagcgtgtgtaggctgggcttggtggctcatgcctgtaatcccagcactttgggaggccaaggcgggcagatcacttgaggtcaggagttcaagaccagcctggccaacatggtgaagccctgtctctactaaaaatgcaaaaattatctgggtgtggtggtgcacgcctgtagtcccagctacttgggaggctgaggcaggagaattgcttgaacccaggaggcggaggttatagtgagccaagatcgtgccactgcactctagcctgggcaacaaagcaagactctatctcaaaaaaagagtttgcaaagcttttctttgtgacatacatatgatcatttaaaaatattatctcaatatttgaagagacaatatgcagtctataaacaattttcaaaatgtattaattggatctaatgaattgtttttcaaatcttctaagtactttattttggtctactttattgtcaattaaattatgttaaactctcccatacagaagtttctatcactttttgtatagctgacagttttttctttatatatttggatgccatgttttttgcaaaaaaaaaatggttcataaatataatatcttcaatacggtttgtatcatcaatcaatataaaatgaatatcttgggatcaacatggttgtgtggtcattgttcctgatttttttttcctaatagagaagtgacatgctcaaatacctatttggagaatggattgattaggaaaaagtgagactgaaagctgagaagccagtgggaaggctcttagaatagtccaggtgagaaatcatgagtggctggattaagacaaaggcaaccaagaggtctatgtagacttggaattaattgaattgggtgagagaggagttgagggtgacacctacatttctgatttagctgaccattatctagacagcaatataggaagaagagctgggttggcttttcagaattggccatgttctaaagttccttctgtttatattcatcccaaaaggactcaagcccagacctaaagctaagtgttggatctttgtcagctgattgtttactcaaaccaaagtctttctacctgtataaaacactaggctgaatattcacaaattttagggtaatcacacttcttttacgtgttaagagctctttcataaagttgacgaaaaatttggactgaacgagagggaattaatttcctataccgtgcccaaggtagtccacatgtgaaggttaagttttccacaagagggcagcatcacctaataaattatgtcattgtaagccttcaccaataggggctgagatggggaggctaaaagggtagaaaatacaggttccgggagccataggacctgccacaccatgaaaaccaaagggccctgctagtccaagcccataattatagccactcctaagtgactgatagtggcagatgttgctacagtatgaggaaagaggacatggaactcaccctggcgagatgagtgggtgaaacacctgaacactctcattcttgtgactggctcagaagacactctagatagtgttcacactccctctaagttgctggtgtctctgtacaaccagcatctcacaggggcctttatttcttattcagatcattgccacccctaatgattccttagcacatcattctctgcaggttaggctgcaaagcacaccaccattctgatgctctcccaatttaacaatgtttgtttattccaattatgcttcttttagaccctaaggaaacaaatgggaatgaaattcactgacaacccattatgtgacagtcattttacataaattatcttatttaatcatcacaataatgccattatataggaattattatttgtcatataagagacctaggaagttgcaaacatgggaatatctaactccaaaacaaaaacgcttccaaattcaccaaattacccctccaagaagccttatttaagacctaaatcttgaccaatccaagatttaatcagtgataatgtatctattatataaggcattacttaacatgtcacctcctatccatgtacatgggcaggtatggattaatcttaggtaccagcaggtaatagaagtcagtgggatcctacataacctcattcttcctaggtccaaagcctttctccttaaatattctctcttcaggataaatcatttggatatagaacatgaggataatggaataattaaagatggcttctgtgtttctgacttggttggctgagtacatacatagtggtcctggtcatagatagcgatcttgggagaagatgatgatgtgttaggtttggggcatgttgtgtttgcaatatctctgacacatttaagtataaatgtctaataggaagttggttatatggtctggagcataggagatatagaaaataaattgaagctatagggctgggtgagattttccagggtacattaagttaaaaatggtggaactatgggaaacaccaacatttaaggaatggtcagaggaagagcaggtagtaaagagcctggtttttaaaaaatggacagggatgtaggaaaataacaaggaaactgactatcttgaaagtaagaggtttggccgggcgcagtgccttatgcctgtaatcccagcactttgggaggctgcggcagggggatcacttgaggtccgaagttcgcaaccagcctggccaacatggtgaaactccgtctctactaaaaatacaaaaattagccaggcatggtggtacatgcctgtaatccagttactcagcaggctgaggcaggggaattgtttgaacctgggaggcggaggttgcagttagccgagatcatgccactgcactccagcctgggcgacagagcaaaactccatttcaaaaaaaaaaaaagtaagagctttttttttttttattaacacgtaacagttatacatattttgggggtacatgtatcattctgatacatacatataatgtgtaataatgaaattaggaaaattgggatatccatcacttcaaacatttatcttttctttatgttgagaacatatgaattcttctctactagctattttgaaatatacaatagattgttaactatagttaccctaccaaactattgaacactagatcttattcattctatctaactgtatttttatacccatcatcaacctctcttcaacctccccacttcccagcctctagcaaccaccagtctactctctatctccatgagatccctcttttcagcctttacatatgagtgagaacatgtaatatttgtctttctgggcctgccttattttacttaatgacctccagttacatctgcgttgctgtaaatgacaggatttcattctttttatggctgaatcgtattccattgtatatatattccccattttccttatccattcatctactgatggattaggttgattccatatcttgtttattgtgaatagtgctgcaataaacatgggggtgcagatatctcttttatatgatttcctttcttctgaatatgtacccagcaggggactgctaggtcatatgataattctattttcagttttttgctaaacctccatactgttttctatggtggctgtactatttcacactcctaccaacagtgtaccaggattccccattttcccacatccttaccagcatctgtttttttttttttaataaaaaccattttaactggagtgagataatatctcattgtggtttttaatttccctgaagattagtgatgttgagcattttttcatatgcctgttggccatttgtgtgtcttcttttaagaaatgtctattcaggtctttgcccatttttaagttggattttttttttttttttttttttttttttgctattgagttgctgtgtgagatttttggtattgagtttcataaaggaaggtgggggcaaaatctagagctataatgttaaatgccatatatgatgaatatgaaaaataacccattgactttgacaattaggcaataatttgtagcttttgacagagtagtttcagtggagttctgagggtcaaattctggctgcagagggtggaaagctaaatggcaggtggagaagtggagatagtgactatagactcttcctttgagactgagtatgaacaaaaggagaaagacggggcaggagccagagggagaagtgagattgtgggaagatgcaagatggaaaaacttaggtgtgtatatacgataaagaaaaaaaaaaacaatagaaagggagaaggctgagctccaataatacaaagcaaaggcgcagcagcaaaatgaaagaaaagccatgtggaaagttcaccaataggcagatgcttttggtggtagcagaatgactgtgcccaaatatgtccttcccttccttctgcttatgccactgcacttacctgcaatgtcttcctcttctgatggtttatttttcaaattatactcaccctttagcttaaattccacttcctctatgaagtcttaccctatcaataccttctgcagtgatctctttctctaacagcaatttttgtctgaacaatccatttgataatcacacacaaggctttattgccttctttaaaaatatactgctacttagtcacatgtgtatattttgtcccctgctagactgtgcaatcctcaaggaaagggtttctaagagtttgctacagcctccatggctgtagtaggggctctttaagtctccattgatatgtggttcaggaatgatagtgtattataaagaaggagattgaaaaacactggattaggtagccctttggtatataatgagtaatttagtcctctttatagcaaataaggaaacagtcttgcagaggactaataaatatatccaagattatgtgtctatgtggcagtgccaggatttgaaccaaaggctctttctcctgtgctattctgcttcagttgtctgcaaaattctattcaagtgaaacacctctttcctttataatattgatagagacatgactctattgagctttattaccaaccaagtttcagtggcctctgcaccttacggagaatctccctgtaccttacctcctgacaatcagcttgagaatccggaaggagcctttgatgagaatgagggcctcttggcgggagccatataatggagtgccattgatattcaccagctcatcaccagtcctcatcttctgggacaaagctgccttgcctccatcttcaatctgtgttgcagagaacaaaacagaaagcaggtagtgagatgactttctccccaaaattctacttgtttcttccaaccctggagccacaagtagtactggggaatggctccaggcagctcctgggagtagctcaggagctgatcacaggtcattatttactgaaggcaaagcttgggcaaacctttgaggaaggaggcaacatggaaataatgcaatccctgactggaggaatgagcagtccaactgggaagactagaacttctaaatacgaaactgatgcttggaatgaaccctactatgtggctaaagcagcagcgtggcctaccaaaacgtgcagacaaattagagccagaagagctaggctccatcaaaatgacctttggtaagctctttcctatctttgggcaggctttgaagtctgacaaacgtaagtttgaatcctggctctgctacttcctagctgtgtgacccttaggaagttacttaacatctgtgtctcaattccctcctacgtgacatgtagataacaagactagctacctcacagagttgttagtatagtatatatctgagaacagtaagtcctcaattaacatgagctctgattattataacaagggagttgactctgaagacctggaaagtggcttacagttcaacattctgtgagtagaatggcaaattcaaaagatacaagtaggtacaatgtagctgcttctttatctatgtctcttcaacatgtgcccagcacagtgcttctagtgtctgacacacagtgagcattcagagaaagctggaaatatgggtatttactgttccaacacagcctatagaatttccactaaccagggcaatctggggaagaagattgtcagactgaggggtattgaaagcaaaggcagaaataatagccactggggcaggcaaaagcaaagcaaagcaaagcagaatgtctctgggggtccttgcttatggctaattttatacattcatttttattacattccttttaccatgaaggtgatttccacctattagaacatcaattccatccatgataatccatgaaaggagtcatctcatccatccattaatcattccttaagtattgaatcacatttctattatgtacaggacaacatgctacatgctagagatataaaaatgaacaaggctcctaatttctagcctcaggggcagaaattagttgtctacagcttgtttatcaactaagacggtcaggtaaaaaaggctccaactcactgatataatcaggagttgtttttgtttgtttccagggaaagggaacgtaaggataattaaattgtatagtccttaggggatggcagattctaaatggggcaattaagggctggtattcactggaggtatttttacacttctactcttgttccaatctctctctcagtcttttataatgtctcctccatctatccccacaccatggaagttataatattgttgagctttaggttggccagctcatgtgcaaatttggcagatgagacctcctgagtgcagagaaaaaattaagttcaggattttttaaactccatcgaattaattgaacttctgagttaaatcacagaatgttattacatttattgctgctaatccaacttttttttaaaaaaattaacctttgtctgacaaatcataggttagccaagtgacattgaatatatatgcctttgttccggtacccgggccacactcaacaccaaacaagccaatattggtaaatggggaacaactctaagcaaattaaacaggattacactcttatttccattgtcattatcattattacttcacagtcactgctgcctaccgccaagaaaaaaagagagagagaaaaggaaagtgctgtacttgaatttcagaagttctatttgaatgactcattactttggcatccatagaaggcccttagcaccagtcagaactttcaacagggatcagccatttgaaagagtttcccgaggctaacaaagaaccacaaacagaagtctaactaatgaatgctaatagattttccctgttgatgtacattagtcttaattcactctacccattgtttttaattcatacaacttaattatccatattactgttacccatagcaagtcttcccctcaatatgtattaagtaccatctttcgttaattaaacactctgttacagcagcaagatctctgtttattctagaccaaaagataaaaggggaaaaccttttaaactaaaatgcttaattattgctgtagcaaaagctcaggcatttggcattccttactgctccttcagctgccactatctgagtccttgcacagactccttcttggactacagcatcaggccaactgttcataccccttttttctgttccatgccccttctcagtcaccagcatcctcctccttaagagatatgttaagtgaaataatcctactttagtgcaagtctgaagatgctcagacaaaaagccagcaaattttgggtccccagcataatccaagagttcagaagggtccagatcaggaagtaagactccatttggttgaagatcccttcaactatatcccagactagcccttttccagacccagggtatttactgagctgtgcaatggactctatactcttccagacttgttggtcctttttaaattactgctcactggtctttctcctccccactctacctctagatttctgaggtctagcacgtcttctatttattgtctggcctccttacagccagttctataggtcaatgtctcagccacatatttgtttatatggaagacaaagcagatgttcatgtttctatcaataaaaaaaggaaaggaaggaaggaaggaaaaatgaatgagaggaagggtgaagggggatggaggggcgaaagatgatatgcatattcttccgtaaaaggttttgttttccccttcccaccttcctcctcctaactctggctggggccctggaaaggtgtgaatcaacaaacttgttgaaattaacataccttgtttgaggggctgtataacaatatatgatgctatccattcagtaagctttccagctcttcctgaatcagaccttcagggtggctttcttgtttcagttgaagtgttgtgaattctcagattagacccagatgcattggaatgtcggtataaacacacatcacaaagctcaatgtaaacgatggttaacttatgtgtcattttggattacccaagtgattgctgggctagcagtgagtggcccaagtaattgaaaattgattacatagaggtcatataaccaaaagccaggtggtgcctggaaagctaggaagagctgattgactttggacaagtccctttcccttcttgcagcctctcttctcttactggtaaaatgtgtaagagggactgaccagatgatctcctggggctctgacagctctgggccttttcagctctgacattcagtgacctgtgaacagttagcaaagtcatgcattatccttctgctgacacagataatctcagctttttgtcccattgtactctgccttcacccatgttttactccttcaaaattgactaattaacatccatctctcaattcccctggtctttatccactgtttcagagtggtccaccaaggttggaacacttaataaggcccagtcaggacactgagagaaagagattcctgaagccctattttgtgctaatgagctagcaatttggaaatttttgatgggtcttcaatgaagcatgaagtactctgatagctgtcaacaaagtgacaagttggccccttgagagtaaaggcaaacaacaattgacttaacagcacttgctggctttctagtagcttttatttagtcagatactaacagatacttgcttgggtctttgaatacatttaggagatgaaaaagggaatagaagaattattaaatcaggtttataatttaaaaatgcattcagaggagaaacaccatctgcagcaataactgacaggtactgaacacctattacaatagtgtaagagcagcattaaaaatcagtgacatgattgtgaatacctctgcctgctacaggaaatttattggaaaaaatgggcatcaactgaaactttcttggtcagttccaagagcttctggccaaattaccagcccatactgctacctccaccagcttgtctatcatctaaagaaggcaaacaacataattgtttaaattgatgtgtttgtttttttgtttttgttttattgtttttgcaaatagacagaaaagatccactcagaatactgtagtccagttatttaaagaaagaatataccttccgaatatctttttagcatcttagaaagattttcaagtttttactaacactccaggcatccgttcatcaatttggccttttctgggaaacgaatagaaaaatgtagagctagggttaagctggctttgggaagtttaactattaagaagtaggagcatcaaagaatgaataaagtgcttgctcattctgaaacttagtttgaaatcttaagcaaaccacaggttgggggctgtttctaatctaccctctttttccttgttggtatctcttagaatctgatcatgctaggagaaattaatcagggttccctggacatgggagatacaggctttcaaacctcggcagtcttcttgccatggctttcaatacctaacttgtctctttcagcaacttcttcccttaaaaaccgctctcaaatttccgaagcagtctagattagaaaaccaagaaactctgttcctaatttcatcttccgtactttacaccagttttccaaaaggcaaaacagacaacaaaaacttttcaatgagaattgaaaaacaataaccaattaaaaagatgtaagtagacctgattcaaaggagtaatccctatatgtggatagagggaagaggtgtacaccaagggagaagccattctttccctctaccagctaataagcagatgcccaaatcctacaaggagctgccccagagtataaagctctgtgaatcaggcccaagggctcccctgaccttgagccaacggaactatgcgctgtgccccacagcatgacctagcccaacagacagcttcttcctccccagctgcttaatcaccatctagtttactaatcctcacaacaaaggccgtctaagctccaaatcattaaatttccctggggattagctccagtcaaattctaagcatctttgccaaaactcagcccagtgccaccagctctaggaatttggtggtgaggacaggggaagaagactcaagagcactgtcccctatgtcagcaaccaaaggcaaatttgtctttgctcctgccaagtcagatcgtcctgctgtctctataagtctggtaaggggagacaaacgtgacggcacaagagtaaactgagggtttcttacattgctagcagatatgctcactggggctctgtcacctctagccatttgtttacactgaagtgttcttctgacattaatgctatcagtgtttgtggcaaatgttagtctttggtggtatagaacaatagtgttcagaatggggtacatatatcccaggctgtgtacaaggtgatccactggaacttctgtttatatatctacaaaaatttaaaaatcaagctttattaatatttaatattggtgataataaattagatcatccataaataaaattgtgtatactggggacacatactcaaaacatttttactgatgtacatttttactaaaaatgttagctggattacagacccaatgagaggactaaaatcataaggcttttagagaaaaacatggagcatatctttgtgaccttgaggtgggcaaaaattttttaagcaggatgcaaaaggtagtaatcataaaggaaagagtgatacattggagttcatcaaaataaaaaaaatcttcagctctaaaaaagggaaaagacaagccacagactgggaaaatattcataatacatattacctgacaaatgacttatatccagaatattaaaagaactacaaatcaataagaaaaaggcaaatagccaattaacaattggcaaggcttgaacaagcacttcactaaaagagatagccaaatacccaataagcatctgaaaaggtgctcaatataattcttcattagggaaatgtgatttaaaattatagtaaagtgtcactacatatccaccagaatggccagaattaaaaagacttaagtattggtgagaatgtacagcaatttgatctctctacgttgctggcaggagtataaagctgtacaaccattttggaaatctgtatgcctactctcagatccagcaattccatacttagagactccgaagagaaataagtgcacgtgtccataaaaagatttgattgttcacagcagctttattaataatagaaagtaggaacaacccaaatgtccttcaaaacatacacatacaaaaaatgacatgctatacagcagtcaaaaaaaagcaatatatgtaataaaatgaatgtctaaaagattatgttgcatgaaagagaccagacaaaaacaacacatactgtatgatttcattttatatgaaggtaaagaagagaggtgataatttgaaaaaatggttaactctgtactactgattgtaaaggcagatgagcataatttttggggggtgctagaaatgttctacatagttatctggctgcagatcatatgggaatatacataactaaacattcattaagatttgtgcattttactatatgtaaattattccttaatttaagaaagaattaaaagaataattagatcagattctaagagataccaacaaggaaaaagagggtagattatgggggcagtttccccaatgctgttcttgtgatagtgagggaattctcacgagacctgatggtttattctttattctttagtctttaattctagactattcagcttatatttctgaggtaggcaccaagactccagcatcattttcacatactcatagttttaatcaaggcaaaacatttctcttaaaacgttagccttcacaatagggctataatctattaatctacccactgttcctgtctgctttgagatagtattcatcctccctacctcttagaaggtagaggatttcagtaaaaaatgaaaataaagaacaacactttattttaccagttgacaggtaaaggtgaaaagtcttaatgatttgattccatttttaatctccagccaatttttgtcttgacatattataaaaatagaatcaattcctcatccaatgttggagccatctactgctactcctcttgtcaatatcagatatgtttctttcttatggtccccagagttcatgtcaatctcagatatgtttctttcttacggtccccagagttcgtgacacctactcctagaagctgaacttcatcaggctgttgtcacacaggcaactagcctttcctcaggcaccattactgtccctgatatggttaggctctgtgttcccacccaaatctcatgttgaattgtaatccccacatgtggagggagtgacctggtgggaggtgattggattatgggggcagtttccccaatgctgttcttgtgatagtgagggaattctcatgagagctgatggttttaagtgtggcacttcttcacgctctctctcacctgatgccatgtaagacgtgccttgcttccacttcaccttctgccatgattgtaagtttcctgaggcctccccagccagccatgtggaactgtgagtcaattaaaccttttttgtttatacattacccagtctcaggtagtatctttatagcagtgtgagaatggactaatgcagtctctttgttagattgcctatgtttcttgactgtctaataagatatgactttcagtgatacaaatgatcagagaaccttgcaaagctgatgtggtggagagagttcagggagaaccagagtggaacaaaccggaggaatgaatatggtagagtgcaagtgaatttgctcctgatttccagaagcagttgtcagcaacagagtttacccttgtatagcattaaaatagtctaggacaaaccagaaagtccataatgtcctccagcattaagagagcactgtgtacaaatctagcaggtgagccttaggaggctgaaaagaccaacagtcttttacctaccgcctaatataaaaacactataaagaggacatatcaattcattgtcattttcaaactgtgcattaatacttgtaagaaatggccaaattaaaacaagaggtgtgttaaattccaccagactgttagagagtgatgggaataattctacttggattaatataatctttatttcttcagtaacaagccattgttgatgtgaaaactatttttcaagttgatcaaaaatgcctttttaacttgcctactgaatgtgagtgagttggatacagtcttccagcccaagaggatgtgattaactatctggaatctgaaccatcccaaagccaggttcactcaataactcactgctggttctctaaagccatttatttataatccattatgcaaaaagccaaagacagtttctaaagagtacacatagccaacattagtcatttctgactggaaaaggacccagggactaaacacccttcggggtagggacaaaaggctgcctctggaaactactaggcctgctttgctgcctgaaaaccacttgtccagcttactaggagcctgtataccctccagcagatgtggacgaagggagagggggtttgttttctatttcccggaggtgggcacctgcatgccactcccagaacattatttgaccctgcccaggccccctttccttggcagtaattttaatctctggtctccacttagacctctgaccagtgggaggtggaggaggagaaaagagatttaacttcctcttacccttatgaataactgctaccaaagcaaacagctcccaaataaataacctaccaaggcatacatgtatgttgcaaaagcaataataataacatcctttactgagcctaggacagatcccattttatattaaatcagcacacttgctgctgctttcacatagtgctacaaatctgggaataagtgagccatcacacagtctgttccaagctactgtcctgttcacatcatgactgagaaatgacacaccatctctttcctactcaacaaaacgtgccaaataacataaaacaaaactgagtttccacaactgaaaaaaaagaaaaaaaatgcactcaattgcttatgtgttagtggcgggaagggactcttgcatcagagattatttccttttgcaatgacaggattaagttgagaagaaaatgcaggaggaagtgataggcatttgagttcaagacctggaaaataaataaggcaagcaatgtgaacgccattctctctgacatcagacctgctttttaagttaaggctggataaaaagagaggaccagatttttagcttcagttcctgctcattctcactcttctaactttaaacaagagtacagtcctgtcccttctcctataaaggttgaccccctctgatagcagactccacaaccttggcactgacggtgttcctcacagccgaggtcactctggtgcttttcctcctccctcaaactttttccaaccctccctacacattatcttttccactcccacctctccctgccctgccaacaaggcatttgagctcgccttttctacttcatcttccccttctgcccccctactccacacccagaccctctccttgggtttcctatgggcaaacttcaagccctcctgtcattaacatctggtactaacattcattaattaaatcagacagaccaaagaatgatttttacaatgtaaacagcagcagatcagaagctctacatgatctggccatgcatgcctttttgaccttatttcccacaacctctcatcctctacacacacacacacacacacacacacacacacacacacacacacacacgtcataccaaactttctgttcttcagagaggtcaagcccatccctatctcaagatctttgtacttactattctatctgttgagaacattcttcttctagatcctacatacctccttttatcattcaggtgtcagctcagatcttgcctcctcagagaggcctttcctgaccaaccacataaagaatgttccttctcttctctacccacatctcatcactctctatcacattacctgtcttattgtcttcatagaatttaccaccatcttacatgatctcacttatttctatgtatgtttacttgctgtcaagatacattatagtgtgggagatagtcaatgcctttatacagctctgtcactggcacctaggaaaataaatgtctgtattgaacacattgtagttgctcaacaaatatttgttgaaattagaattaaaagggatctcaggatatcaccctattcatttgactgattctggagaagtaacaatattttcactttgtttttcatataactgaggttcagggatattatatgacttgcccgggatagagcatctattaggtttaagatactttcttctgcaaggttgtgacaaaaccttttggatttcacgggtatattgctattcatgatccttaactagcaatactaagagttcttgctaaagagacactttaaactttgtaaaaagcattattattggctcagaataatccagaataattatcctttgagctaaatatcccatttgtcacgaggtgccccagggtgaatgttagactctcaatttagtggaaggaatggagcctttaaggaaactgaggtgtatggcaataataacttgtatccagatatgattctcctcagtttttaacattctctgccttaggaagttaatttaaaacacacacaagccctcacaaacagaccatgaacagtgggatatttaactactcccaccatctgggaattcaaagtaacatcgactccaccttcgtgtgtacagacattacaacaggctctttcagttcaccatccctgaaaaatttaagagcaaatccagatgatgggcataaaccagattctaatttgatttagtgcttcgttaaccagtgccctcagacccccaaaaagtatgtgtggggtggggggaaccctcatcaatgtccaaatgagtttgccctgacccaatttcatgcaactatagttctttccttaaaaaccatttgttcagtgggtttagtattttatacctctgtgagttagtgattataccttttgtgaggcttttcatataaacaaattcacaagtcagaaaataaatcctttgtcaagccaggttttctgattgggatttagaaaatatggccaccatgatatggctttaaaaagtttaatatctgtagcatgcattcagtgctaatggacaataagtgatagtgaagttttgtcaggtctgattcagattacctgtggctgctgtgagttatatggaattacacagagtttaatggttctctggcaatttgccttggctcagggccaaggcagctaacgcttcaatcaaactgctctccccacccccaccccaagacaatttcagtttctaagtcttgagtgtatctgtgatgaagccttcagtgacactctcatacaaatgccaaaggttttttttttctccgtctctttttcttccttcttctttatggctgcatatattaagtgctcctgtagctctgctgagacaaactgcctggctggtgcttataaagagaagagcttttaaggtttgattaaaacagaggagccaacagtcagaagatgagaacaggacaatatcccttttctctgcagtgccatcagatatatccaattcaccctaacatgggccctggacccaccctgcaggccaacttaaggcagcagccctcccaaatcacttgagtaatcaaagaacatatcccatcaaaggcaggtagcctgcctgacagaagaatcccatgcatggcaagttaccctcctctcttttaggaacccaactggccctgaagctgggattctgccacagattcctggcatcactttagcatagttgagacagtggacaaaggccaagtgaacaaaggccagaaacgtcctctacaaacttgcaaaaaaggcatgtacaactctgaggtacaaccgttctgtggatagcaaatattctgggtccaaactctttcatcaatcgctgttcaaccctgtcccctcaacctctcctaaaacctccagtggtgcttcagcactagcacctcctgctatttagctaaagtgactcctagaccctttgtccaactgattccaatgtcacatttactggctattctagagagaatgctcattttaagagactagctgccatagaagcagcaggagggaagggcagaaaccacaggattcctactttgcgctgattgccactaactcatttcagctgctaaggggaggccctgttgggggagccaggagaggaaatgggttccatgtacggtccactttaaattgttcacaattgcgtgctcaaaaatagtctctactaaacatttagcacgcccattagcacaagccataaagctttaggctttgctgtactgttcgcccaggctgcctaagctgctttcctatggcaaaatgatgaaatggttggcaagtcagatacatgcgggaaggataaaggagctccaaggatggttaaacctggacccaggaagaatggtttaatatgacttctaagcacataaaaaaaatttagagggaaggaccagctgttctcaattttgattgaaagcagagcaaaggaaaagaaactgacattgcaacgagaaggactgatataagcaaggaggaagaacttcctgccaggcaaaataggtaaatgttagactgagtggtcagtcaatgaaggttgtggaatttccttctttagagtggctcttctctgctatttctgtgtggtccttccagaggggtgggggacggaggaaagagaggcagccagaggtccaatttagtccctttcagcactcagaatctcttatttgcaacattccgggatctgtaacacggtcactgggacacttgaaaagaaagaagcaacgagaagcttgctggtgatcttaaacatttagattctccccaactttctatccctcacaatgagccaagcttttgccctggcccccacaatcccaagaaagcaagcgaagacttgcttttggctccacagggcccctaggccatgcatatgggaacaatattttctgaacccaaaagcagaacatggtctgacaattatatttatgaggacaaaaggatagaatatatgaaatcagagctgtcccaggaaatctgggtgtatggtctccatagccacatattatctcttctgagggtcccaacacagaagggagttaattaaaactatgccatgtggttgggggcctagattctttccctgtatgcagcaagatcagttaggactgtgaaaagatagggtcataataagtccagtacaaactgaaattcctgctgtgcaggttggagaaaaggagtagtctatgtgtctttcctagaatctcttcactctaaaatgcagctggagctaaggggcatgcctgtcctcactgaatcataaataatgccatatttatagaggggaagaaatgtgtctggcacaagggatcctatttatacattcattcattcagtactcagagcagtggttctcaaagtgtggtacctggaccagtagcatcagcatctcctgggagcttgttagaaattcaggactcaccctaggtcaaatgaatcacagactctgtgggtgaggccagtaatctgtgttttaatccctccaggtgatgctgacgaatgctacagtgtaaaaatctctgaattagaagtcctcctggtgatgctcacattgccaaccagcaacaataatattaaccaaaagaatcaaagtcacaggcatgtttggtaggggcaggcactagcccatcagtatctctgctaatttagcctataataactctcacagatttctcaaacaacttaaaactaccattcgacccagaaatcctactactgagtatccaaaagaaaataaattgatctaccaaaaagacacacttgtatgttcattgcagcactattcacaatagctacgacatggaaaccacctaagtgtccatcagtggtgggtcagataaagaaaaggtgatacatatataccatggaatactacgcagccacaaaaagaatgagatcatgtcctttgtagcaacatggatgcagctggaagtcattatcctaagcaaattaatgcaggaacagaaaaccaaataccacatattctcacttataagtgggagctaaacaataggtactcatggacataaaaatggcagtaataaacactggggactaccagaggggagagggagagggacgagggttgaaaaactaactattgggtactatgcttagtacctaggtgacgggatcaattgtaccctgaacgtcagcatcacgaaatacacccacgtaacaaacctgcacatgtacctcctgaatctaaaaagttgaaattatttttaaaaatgtatacacatataaaaaataaataaaaaatatctcacaattcctgggtcatggaatagtctgaatcttactacacacccaattccttgaagcctgggtttcaaaggtaactcagcctgtctgctttgataagattctttcaaataagccaaagtccctttgggtttttcatctaaatcctactcaggcacacacactcctctgagtattctgtgactgttttcgcccttagccttgatctaagtctcaaggaactgactagagctcactctaggaccaagccaggaacattttatgtttaccagccttatttttaattttaaacaaacacagatgaaagagtccctgctgtaaagaaccaccacttaatgctagcccttataccttagtaacattaaattaaaataaattacaacaaatagtcattgtttcacctcagtttaaaccgacaaagttaactgctgcaatcaatgggcaacctttcacaaacatttgctgaaaaggaaaagaaatgcttccaggtgaaacttatcaaagtgaagtgcactgaggaccaaatcttattgtatgccacctggttttctcccaaagcatcagtcaaggaaagaaaagagatctcaacacagcctcccagttagaatcaatgacttctaaccaccaacagagattctggttcaggtaaggaagttacacagcatggttaaaaccaacacacatgaggggaatttctggggtgatggtagtgttctatacattaatagagattttggatacacaagtgcatgggatgtcaaaactcacccacgtcagattttgtatttcattgtctgtaaattttacctcaaaaggaaaagaacacctgtaaacaaacattgaactctagtaaataatacacgtgctgaaattttagggggacctgcactgatgtcctcaatttacttggaaatgtatcagaaaataatattgatgagtgaatagagaaaatcaatacatgaatagatatgaaacaagtatagcaggaatagattagtagaatctaggtgatgggtatatataagtgtttaatgtaaaattcagcttttctgtaaatttaaaacattctgttataaaacgtcagaaacacacaaaaacaagtaaaaaatttggatttttattgtcccacagacctttcattgatgtatgcattccaatatgcatgaactgaaatcgtactatgtgcaaggcactagatcaaatcctggttctgccatttagtgacagtgtgaccttgggcaagtcacttcacctctctgaaacctgtttccttatttgtttaatggtgagaataataacacctacctcccagggtggttattgttgaaattacacttcaattgctgaccacctaatgagagctatattgagtagggaactctcaattaagtgctacttgttcctctcccctgtgggatctgtaggggatctcaactatggaaattcttttgtgtcagcttcagcttgattgctgagcactttttgtttcttgaaaattgcagcctgggccacgaccttatattatggtgggtatatagtgttcatatgtttcaactgactccctgacattcaattgagttttggttttcaaactcccctttgcaaacaagaaaaattagaaagattacccttcacagcctctggtaaccatccttctacaacacggagactatagtaaatagtaatttcattgtaaatgttaaaataactaaaagagtgtaactggattatttgtaactcaaaggataaatgcttgaaaggatagctaccccattctccatgatgtgattatttcacattgcatgcctgtatcaaaacatctcatgtaacacataaacacctattacgtaccccaaaattaattaaaaatagaaactttctgaaaggagtataaagcaaaatttaagcaagagattaaagctggagtgtggtctaaggtagttctgcctacatccatttgaacccatggtgaaaacacttgactcactctcttgcttaccttctctcatagttctgacatcttttccagctctgggatgactccccacaaaacagaatcctgtcatttggaaaacatgctcaacccttgttggtttccttttcagttcacttcctgagaggattctctcagcactcttccccttgatgcgtatcccatcattcactaattggtatgagagaggtgaaacagtctgcttttcaagggtaggtgtatgctcctctgcaaggggttgcgtctggcttctctgagtcccctacctggtttgaggtaacaggaaggttgactgttctgccaggaaagcactgccaaactctgggtctggggaagcaactcgagagcaggcaggcgggtatccaccccaggagataataaagcacagcagaaaagaaacctgggcctgagaagctgtccgggagggttctttacgagcctgtttaacagcagagctctatgtagcacaggaaatcatgcacccaaagtgcagcagactttatagtggtcagacctaatcaggctataattaaggcattttaggaggcaaaaagtctttggcagcaatgatgtctacacaagagagtgatgtcaagcaattatttgtcactgggactcaacatctagcccaaagattcggggcaggcacagtagctcatgcctgtaatcacagcactttgggaggcctaggtggggggattgcttgagcccaggaatttgagaccagcctgggcaacatagggaggccctgtctctaaaattttttttttaattagctgggcatggtgtcatgtgcctatggtcccagctactcaggaggctgaggtgggaggattgcttgaacctacctaggaggttgaagctgcagtaagccatgattgcaccactgtactcccacctgggtgacttgtctcaaaaaacaaaagtaaaaataaatttaaaaataaccctaaggttcaccctgtcctcacagtgccacccacagtactgatgggactgattaaactagcacttgaaaaaatgaaaagattgctttattttcttccattcaacgtgttgtctcttcactgtttattgcttcctttgttgtgcagaagcttttaaatttagcatggtcccatttgtctattgttgtttttgttgcctgtacttttgaggtctcagccataaaatctttgcccagaccaatgtcctgaagagttttccctaggtttttctccagttattttatagtttcaggtcttatgtttaaatctttaattcatcttgatttgatttttttatatggtgagagatacaaaaatcatttcattcttctgcatatgcttattgagttttcccagcaccatttattgaaaagggtgtcctttccccactgtatgctgttggtgcctttgtcaaaaatctgttggctttatttatttatttacatggctttatttctgggttctctattcttttccattggcctatgtgtctgttttcataccgacagcatgctgttttgtaatatagccttgtaatatattttgaagtcagaaggtgatgcgtgcagctttgctctttttgctaagcattgttttagctatttgggctcttttttgctttcatacaaactttaggattattttttccaattctgtgaaaaatatttgcaaactattcatccaacaatggacaatatattgtatatttcaaagtatctagaagaaagtatcttgagatgttaccaacacagaaataataaatacttaaggtatggataccccaaatacactgacttgaacattacacattatatgcatgtaacaaatattcacatgtacctcttaaatatgtagaatattatgtatcaataaaagaaaaaaaggaaaaaactggacaatggggtgggagattcctttatatttaaataatatttactgtttttaaaatgcacttcaacacttttaaattataactttaatttacagtatgttaagatagcaacacagtataggagagtgcaacttttaatgataggatatgtgaaactctgtagtcaaataatccttcctgaaaaagttgatacacctgcccaaccagttattagaggctcaatcttctgcaattcccagaggatatgctacagaagatcatgaagcttcagagaatactgttctgccaatgaaggtccatgttcagagacattttgagaccctgttacatagagaggcttagttttcagactgttgattagaagctctagggaacatgtgccagttaaccacaacagatggagaggagggagaaaaaagttcattacactgttgtttactcattgttttctatagactctaccccttagtgtgtccctaaaatacaaaataagaaggctgtttgagggctttgcttatatatgtttctatgttatacagattttttcatatccctcttattgcttgatacgctcctgacattctgcctaccccttccctgtgaagcctggttaggttagtaaggcctgtgcactcccagagcactctgcacacacctctactcttgtgttcacttaccaagttgtactgaagttgtctgttcataagtctgtgtcccctgctctactgggcagggggtctctctcatacctgtgtccccagcacctatgggtgctcagtagatgtgtgttgcactgtttggggaaacttaaggttagtacctaggttttattttaaactttcaatctaacagtgccttttacacagtaggtgttatgtctgatgatagtaatttttaaaaggcctcagaaaacaaataacctgattaaaaaatgggcaaaagatctgccaaaacattcctcaaaagaagacatggcaaatggccagcaggcatataaaaatatgctcaacatcaccaatcatcagggaaatacaaatcaaaatcacaacgagatatcacttcatgcctgttaggatggctactatcaaaaaaacaagagtgaagtgttggtgaggctgtggaggaaaggtggtggttaggtgctgtggtgaggcttgcacagcggtggtgggaatgtaaattagtacagccattatgaaaaacggtatcaaggttcctcaaaaaattaaaataaaactaccctatcatccagtcatcctacttctgggtatatattccaaaaaaaaaaaaaaggaaatcagtatcttgaagagatatctgcacaaccatgttcatggtagcattattcacaatagccaagatactaaatgtccattaatggatgaatggataaagaaaatgtggtagatatatacaatgaaacactatgcaaccttaaaaatgaaggaaatcccatcatttgtggcaacatagatgaacctggaggacattacgttaggtgaaataagccaggcacagaaagacaaatactgcctgatttcactcatgtgagagcttattagaactattagaatcaaagggtagaatggtgtttgccaggggtgggggcagataagtagggggaagggggtttggggaagatattggtcaaaggatacaaaatttcagttagacaggaggaataagttcaagagatgtacaacatagtgactatagttagaacaatgtatcatattcttgaaaatcacagagattttaagtgttctcaccacaaaaatgacaggtatgtgaggtaatgtatattttaattcgctcaatttagccattccacagtgtttacatatttcaatacatcctgttgtacaccataaatatatataatttttatgtcaattaaaaataatttttttacaaaggtttcaaaggtatatggcaccttatgtgacttaccaaatgtcttcacattatttcacatgacccctaccagcagcctgtttagaagcaagtcaaatattttaacaactgccatttgacacataagggaattggcttggagcaattaactgagtgtccaaggccacacagctaatatgaactcagtggatactttgaatctaccctattgttttccagtgcccatgtttctctcctttttataaagatagaactgagaaactttgacacctatatggtttcccagacttacttgttaggttcctctcacttcaactggagaacaaagtaatgatttaccttgatacccgctgacagtcattatgaacagctgaatcaaccaatcttaaagcctgcctcttccctagaattcttgttatgtgagataatacatttcctaattgtttaagccagttagagtttgggtttcagttacttgcagcctaagtcgtacctgacgtacgatgcctgcttcccaggaagactaaatttcttaaagatagggctccagtcattctcccagtctggccttctctacagcacttccaggctggctcactacaagggactattcttgtaggggtaagggggatccatctcagagaaagggtgccagaggatttcctgaaatgaaagttaacttgttgctgaagggaccaccagttgtaaagccatggtttttttgtttgtttgtttgagacagagtcttgctccatcaccaggctgcagtgcattggtgcgatctcagctcactgcaagctccgcctcccgggttcaagcgattctcctacctcagcctccccagtagctgggactacaggcgaccgccaccacacccagctaaatttttgtatttttagtagagacggggttttaccatgttggccaggatggtctcgatctatctcttgacctcgtgatctgcccacctcggcatcccaaagtgctgggattacaggggtgaaccaccatacctggcttgaagccatgttaattggttgcagcagaagccaagcaaccaaatcagaagagatttaatgtattctccacctcaaccccacacaccagtgtctctcttggcagtgctgggacagaagggacaagaacatttacatcacttccaccagatagtccttcagcccacttaaaaagactccaagccagcatctccccagaaggcagcagtcttcaattactcacattagggcagcagttttcaccccaaatctcaaaaggctttccagcactgtgggtaaggaaaatttccagagagatgactttatgtctcagttccattaaacattcattgtgtggctgagatgtactcttggaatacttccatttccccagtaatagaatggaaataatacttgctctttccctcccttccaaggacactggaaatgtgaataacattcatgaggtctgcaagaagaccaagaaagtgccctgcaccaggttcaggcctagatcctgaaggtttttagaggattacaaacagaatggctccatctaccaacatcctctatgataagcaacaaacatatactgagtgtccactgtgtgctgggtccagagcttggctttggggctacattggtgaggaagccacttgtccctactctcaaagggttcccagtattgtggtagagacaggcatataaatccagatgcggaatatgataatttcaatttgctgatatctgtgtggaaaagttgtgagagataagctggaaacatgcactgggatgagatgaatcatgaatgcaaaagtaatcctaaacatatataaaaaccaatatagcagcagcagcaccaacaaagcagaatagatgcaggtcagtgcatggaacaatgtcctccaggtcccttgctgtgctgggcactaaccctttagtggctgggtccaagagttgggaggggcagctggggcagcaggaggggtcttgaagaggctcaaagagcctctcaaaggatcccataattttaacaagaagtgtggtcatatcagtgaatactagttaaatacagccctgcttctatgtcatgtgaatgagcatgagtgctaccttgtggtcatccaggagccccaaaatgtcattgggttggaaacacactttagcagcagtgtggaagatgggctagattggggcaccatgaagtcaggcagataagtaggaaggctttgtaatataccaaggaagatggatgatgtcctgaattactgaagtggcaggcccaaagatgattacataaatctccatttctatagatctccttggttcctaagaattctcccgtctttttattctcttggctacaatctcctagcccaatgcaaacttacacacacacatgcatgcttgtgtgcagatcctgcttcagtatgtatactcaactagtggctggcaggctgtaattatggcaggcaagaggcctgccaagaaaaattcattcaaatactgaggtcatcctattcccagctgcaagagagtggctacagtataaactctgccttcataaacccaaactatatttttggatagtcttctctatttttccaagcacagtcacacaattatctcatttgttctcttaacaatagtcctaggaggtcagtaaggctgatattatttagctccaatgtagagacgggaaaagtccttcaaagagaaaggacttgcctaaggtcattcacaatgagtcagtagtgactctacgactaagatgccttctacttcttggtcccatgttcctctcaatcttttccatataacctccttcagatacaatttcaggtcatttttgtttccacctcctgcaaactaatattcattctatctattctaatagtcatttctaagagaattctgtggataaatcagagtcgccaattttatcctccaagtccttgctcaggtctcaccattccctccaggaaattttccctggtaactatagttcagtaacctcaaccccttcttctttaaatatttactctcagtattaatgtgttagtgctttatgctctcttgttgtgttcagattactccatctgtgacttgtccttttcttctccccgcctagcacaagatttggcacataagggaacacttactaaagtgttgttaatgtatggcttgatccattaaagcctaactctggcatcagactgcctgcaatttccagtcaacaacaaagcactctgaatatatgtgtttgtgtgtgtgcacacatgtgtgtgcgtgtgtgtctgtgcaccactcatctagtgaccctgagggtaactaactcaatgctgtcaaaatgcagcatcagcacatagttattttacattccagtaggaattgaagcaaggaaacttttctccctaattttttcaaaataaatattgctctggttccaaatggtatatttttgacatcttgtgtacatttctgaaatagagtccagatgagaaaccagctaatgtgtatgtccattccaatctgagaacagtagattcccactcataggcaattttgtttctgaaatctcaattgcagaaaaaagactagggggagcatgtttgcaggaaggggtaaggccgacatgaagtgactgctagacaatctgaggcttgggggcaagacaaggacatggggaagaaaagaaggggatgtgaaaatttcttccctctcctcttatgattgcccacacagatttttaagggacatgaatgggaaagcagctgatggctgctcccaacaaggcaggataattgcaaaatatcatttagacatgagggtggccaaaggcaggtgaaccccaagaagacaggtaaacaggccccagagaacaccatccacttggttgtctgctcagaaactcctccttagagtccccaactgagagtaaaggaatcatttttctatttcttctacaacatacaatattgcccaagtacctactatgtattaagtactgtgcttggcacttaccaatataaacctttttgccttgtagtgattcatactcccattttacagatgaagaaactgagagataaagtcttttactcaccatcccatagtgtgtctgactctatcatgtaggttctttccattgcacaactctgccttcccaaggtatgttcagtgagatctggcaacaagaagaaagctgaaaacccctccctagcaagcctaaggtttcacagaggcacttagtcttaaatgaagagtgggattataacctaatggagaaaaagatggaaagcgcattcattcctggctgaaggaatagcagatggaaaggcactgatgtggggaagaaaaaaaaaatgttcaagaaagtataaatagttttgtgggatcacctgagggtgaggacaggtgatagaatatgaagcgagagcaactaaggccagattataaagggtttcatttcatatgccatgttagggaatgtgggttttctcctggagatgagatagactggaagagagggagtactgatatcagatctctgatctctgttttgaaaagatcactgtggcactgactgcatgcagggacaccgagccaggaaagtctggcaataatcaaggcaagagtcaagatggtgaaccaagtgaggcctagctcagaaactactgactccagaacagttgttaccagaaaggggtctggattcagaccccaagagagggttcttggatcttgcacaagaaagaattcagagtgagtctgtaaagttaaagcaagtttattaaggaagtaaaggaataaggaatggctaatctgtaggcagagcagccctgagggctgctggttgcccatttttatggttatttcttgatgatatgctcaacaacgggtggattattcatgcctcccctttttagaccatacaggataatgtcctgatgttgccatggcatttgtaaactgtcatggtgctggatggagtgtaacagtgaggataaccagaggtcactctggtcgccatcttggttttggtgggttttagctggcttctttagtgcaacctgttgtatcagcaaggtctttaggacctgtatcttgtgccgacctcctgcctcatcctgtgactaagaatgccttaacctcctgggaatgcagcccagcaggtctcagcctcattttacccagcttctattcaagatggagttgctctggttcaaacacctctgacacagtcagtcactgcaaattagcctgaatctttaagctcaaagctaggattccaggctttgcagcatctacccccatagcccttaaatactgtatgtgttgctttggcctcaaaactagtaacaagtcttgctttgtcctctggggcctcctcatttgtctccattttctaagctggcagctttgtggctcccctgggcctagcctagcccagctggctgggggtggtggagagaagtcaggtaggatccaagcagaaagggccatgattagcacatgtttcacattccccacattgcatggcaattcccaaccaaatcctacaggattgttttcttaaagatttgggaggagtttggggcttcttctctttctttcttctttgttttattctgtttctggactgcagctatttcctctgtccttgagttaagtaatagcagagagggagttaaaatgaaagtttgcagcaatgcagaaaagatgtttctagagatgtccagaggaaggagggaaatctagtatgggggcccacagcaatgttctgggaaggccagggaatgtagctgctgggggtggggcttcagttacagcaaatgtatagaagttaggctaaaacctacctaagggaaggggtccctgactctcaggccagcttcagtccttgacttgtttgcatttagcactcagtagattttcctctggtcatcagtacctgctaaaccccagcgcagccctaaggtgtggactctccctttaaccaaggaaattaaagcattaaaatgaaccaaaagcatttaatgggtaaaggcagccagcaatacactcacgggaatcccacactcctaaataacaggagggtcttgcaaaagccttccaggcctgcttccttccgtccatccttcctttcatctctctctctctctctctctccatgaatttctgaaatagaacccagatgaaaaacctgttcatgtgtatgtctgtcccatctaagaacagtagattctgactcatgggcaatttcattccggaaatctcaattgcagaaaaaagattaggagagcaggttttattttattttctatcctccctttccatcatttcccttgagatagcatacatcaataagtagcatgtagggaagcactgattgtttcttaatttatagctttattgagatataatttacacacaataaaattaccataccataaaattcatccatttaagcgaaatgcaatgattgtttagtatatttaaagagttgtacaaccatcaccacaatctaattttagaacatttccattgtcctcaaaaagaaactgtaaaggtattaattaagaaatgatcagtgcttccgtacatgctacttattgacatatgtgatgtcaagggaaatgatggaaagggagggggatagaaaatgaaataaaacctgttctgctaatcttttttctgcaattggaatttcaggaatgaaattgcccatgagtcagaatctactattcttaaatgggacagacatacacatgagcaggtttctcatctgggctctatttcagaaatgtggtggggggagggggggagggagggggaggagggggagaggggcagggagggaaggaaggagggagggagggagggagcaagggagggagagagagagagagagagagagagagaaacagagggagaaacaaacaagcctgggaggtttttgcaagaccctcctgttctttaggagtgtgggcttcctatgagtgtactgatggctgcctttacccattaaatgcttttggttcattctgatgctttaatttccttggttagaggggagagtccacaccttgagggtatgctggggctacagcaggtgctgatgatcagagctttgagctcatatacagtcagtccatgttcctttcaggcctctgagcccatggtaactcttacagtggagggtaagtccgtccccttcttaatcaatacagaggctaccaactccacattatcttcttttcaagggcctgtatcccttccctccgtaactgttgtgggtattgacggccaggcttctaaacctcttaaaactccccagctctggtgccaaattggacaacattcttttatgcactcctttttagttatccccacctgcctagttcccttattaggtcgagacattttaactaaattatctgcttccctgcacagccacacctcattgccaccttttcccccagttcaaagcctccttcacatcctctccttgtatctccccaccttaatccacaagtgtaggacacctctactccctccttggtgatggatgatgcaccccttacgatcccattaaaacctaatcacccttaccccgctcaacgccaatatcccatcccacagcactaaagcctgttatcacttgcctgttacagcatggccttttaaagcctataaactctccttgaagacagaagaagagagccatgagccaaggaatatgggcaacctctagaagctaaaaaaggcaaggaagttctctccttgagcctccagaaaaaaatgagccctgctgacatgttggttttagcccagtgagactcatgtcatatttctaatgtacagaactgtaaaatgataaatttgtattttttaagctactaagtttgtggtaatttcctataacagcagtagaaaactaatataaattgtcctttcagtttctttctttctttctttttttctagacagagtttcgctcttgttgcccagctggagtgcaatggcacgatcttggctcactgcaacctccgcctcctgggttcaagtgattctcctgcttcagcctcccgagtagctgggatgacaggcatgcgccaccacacctggcttattttattttattttattttttgtatttttagtagagacggggtttctccacattggtcaggctggtctcgaactcctgacctcaggtgatccgcctgcctcagcctcccaaagggcgggggttacaggcatgagccaccgtgcccggccccctttcagtttctagacagtgtcttttaaagaacaaaagtttctaattttgattaagtccaatctttatccatcttttcatcacttatgtctttggtattgtatataagaaatcgttgctgatagaacttccagaatagggatatgaggagctcggtggatcctctcccatttaaagtctctggaaattgtcctaatggcttatggaaagtgaagaaatgtttattcaagtaaacttagtgaattttggtaagaacaataggagtcagtggcatttgatacatgacctgttcctaacccatctctatcccagttttatggatacaaggcagatgtggctaagaaaagaggaaggctccctttatccccagctcatagtcaagactaagacccaggctaaggttattctaggatttcaccccagaaggggaaatccactggcacctcttatcctcagtaggcccttgttatgaaaatgctgctctaggaagctgcagctaagtggactgggtctctttcccccacctcgctccactcataagccaagggctctgctctggcaaagcaggccaagaatactaaggccccaatcacctcaccacaacttgctcatagggcataggttccacggtgggaggcgcaagcagagagtatcagggccatatctccctctgatatggtttggctctgtgttcccacccaaatcccatctcaaattgtaatccccacgtgttaagggagggacctggtgggaggtaactggaccatgacggcagtctctcccatgctgttcttgtgatagtgagtgagttctcacaagagctgacagttttaaagtggggcacttccgctctctctttcctgctgctatgtaagatgtgccttgcttttccttcaccttctgccataattgtaagtttcctgaggcctacccagccatgtggaactgtgagtcaattaaacctttcttcttcataaattacccagtctcaggtagttctttatagcagtgtgaaaacagactaatatagaaaattggtattgggagtggggcactgctataaagataacctgaaaatgtggaagtgactttggaactgggtaacaggcagaggttggaacagtttggagggctcagaagagacaggaagatgtggggaagtttggaacttcctagagacttgttgaattgttttgaccaacatgctgattgatggtgttatggacaatgaagtccacgctgcggtggtctcagatagaatgaagaacttattgggaactggagcaaaggtcactcttgctatgctttagcgaagagactggtggcattgcccctgccctagaggtctgtggaactttgaacttaagagatgatttagtatatctggcagaagaaacttctgagcagcaaagtgttaaagaagtgacctggctttttctaaaagcgtacagtatatgcattcacaaaaagatgatttgaaattggaacttatgtttaaaagggaagtagagcataaaagtttggaaaatttgtagcctgagcatgcagtagaagagaaaaacccattttctggggagaaattcaagcctgctatagaaatttgcataagtaacgaggagccaaatgctaatcaccaagacaatggggaaaacatctccaaggcatttcaaagatcttcatggcagcccctcccatcacaagctggaggcctaggagggaaaaatggcttgggccgggcccaaggccccactgcattgtgcagcctcaggacatggtgccctgcatcccagccactccagctccagccatggctaaaagggaaaaacgtacagctcaggccattgcttcagagggtgcaagcctcaaaccttggtggcttatcacatgatgttgagcctgtgcacagcagataagagctgaggtttaggaacctctgcctagatttcagaggaggtatggaaatgcctggatgtccaggcagaattctgctgcagggcagaggcctaatggagaacctctactagggcagtttggaagggaaacgtgaggtcagagatcccacacagagtccccattggggcactgcctattggagctgtgagaagagggccaccatcatccagaccccagaatggtagatccactgacagcttgcactgtacaacctggaaaagccacaggcattcaatgccagcccatgaaagcagccatgggggctgtaccctacagagccacaggggtggagctgcccaaggccttcggagcccctcctgcatcactatgccctggatgtgagacatggagtcaaaggagattgttttggagctttaagatttaatgaatacccttctgggtttcagatttgcattgggcctatggcccctttgttttggccaatttctcttatttggaatgggaacatttacccaatgcccatacccccattgtatcttaagagtaactagcttgtttttgattttacaggctcataggcagagggaacttgcctggtctcagatgggactttggaattgggcttttgagttaatgctggaatgagttaagactttggggaattgttaggaaggcatgattggttttgaaatgtgaaaaggacatgagatttgggaggggctggggcagaatgatatggtttggctctgtgtcccacccaaatctcatcttgaattgtaatccccatgtgtcaagggagggacctggtgggaggtgactgaatcatggtggcagtttcccccatgcttttctcatgatagtgagtgagttctcacaagagctcatggttttaaagtgtagcacttcctcactttctctctctcttctgctgccacgtaagatgttccttgctttcccttcaccttctagatgattgtaagtttcctgaggcctccccagccatgggaaactgtgagtcaattcaaccttttttcttcataaattacacagtctcaggtagttctttatagcagtgtgaaaatgaatataccctataccaggacttgctcatataataggggtgtcaatctagaagaaacaggccgctcttgctacattcagctccagtgcaatgatccacagcttctgcccagagggagaggcaggtaataaaaacagaaggctttagcagttctgcctgaggggattgactttatttggaacagaatatggagaagtttatgtctgacaatgttattaaatcaatggagatcttggtgagcaatttcaagaaggctggtagctctgtgatactagtgaaatgcaaactgatcagaagtttaaaagacagagccatagaaatagcccaaatcccagcactttgggaggctgaggtgggcggttcacgaagtcaggagatggagaccatcctggctaacacggtgaaaccccgtctctactaaaaatacaaaaaattagccaggcatggtggcgggcacctgtagtcccagctactcaggaggctgaggcaggagaatggtgtaaacctgggaggtggagcttgcagtgagccgagattgcaccactgcactccagcctgggcaacagagcaagactccatctcaaaaaaagaaaaagaaaaaaaagaaatagccaagcagagccctcctggggtcaccaacatcactggacatctgaaagcctgtgtgcataagctaggctacacctaatcagaagcaatcagagttagaaggaaggcagacttgaaagtattctccaagccacacacagatccattagatcaaggggcttttgcacaactcctgatgaaacactggctgaacaataggctattctgacccaagggctgcttctaggaattcaggtctaaaaacaaagtaaaactaatccctagtggtctggtacattgtgtgcatgcccaaggctgcaccctcatagaaaagaccagagagagaacatctggctaaatgtaaaaaaaaatcataaacaccctcaactgtgaaaacaaactcaaagctacaaatacatgcaaaagtaaagagtctaactgactaaggggagtaatcataacctttggtgattaaatggttcatgtgcacccaagggtgacccctaagaagacaggataaaaaataagaacaaagaaaaaaaattggggaatggatattagaggctgcatacactactggaaatagactatcaagtcaaaaaataaacagacaaccaaacaaataacagcaagtcccaaaaattgggggtgggggtgggagatggtcattacttaaagctgctacacatatcattgatgtggaaaagagatcacatattattttaaatgtccagttttcaaaagaaattacaatatatgaaacaaagaggaaagcacagcccatacataggaagaaaagcaggcaaaagaaactgcttttgacagagtccaaatgttggacttacccaagactataaagcagctattataaatatgtttaaacaactgaaagaaagcatgcttgaagaatgaaagaaaagtatgataaaaattcatcaaatagagaatagaaaaagagacagaaattataaacaagatagcattctggagttgaaaatagaataatccaaatgaaatattcactagagatttaagttggcagaagaaagaatcaataaacttgaatacagatgaatagagattatacaaaatgaacagaaaaaaataaagagaaacagagcgtcagagaaatatggtacaccattaagcacacaaacatacatatattacaagtaccataaggagaggaaataaagagactcagaaaaattagaaaaataatgacaataaccttctcatatttgatggacaaggctaacttacaaatccaaaaggttcaacaaactccagtagaagaaactcaatgatccacacccagatgcatcatatttaaaatattaaaactaaagataaagaaaaaatcttgagagcatcaagcaaaacactactaatcatatctaaaggaaaccccaataagactaacagtgaacttctcaatagaaaaatatggagaacaaaattagtgggataacaaatttaaagtgctgaatgaaaaaaaaatacatcaaccaagtatcatatactcagtaactatctttcaaaaatgaaggcaaaataatgatgttcccatataataaaaacctgaaagaattcattgctaatagacctgacttacaagaaaatctaaaggaaattcttcaggctaaatcaaagtgacaccagagagtaatttgaattttcatgaaaaacaaagcattgtgttaaaggttaattgtgtaggtagtgacaaggaatatatttctttaccttttatctcttaactgatttaaaaagcaattgcaggctgggtgcagtggttcacacctataatctcagcactttgggaggccgaggcgggcggatcacctgaggttgggagttcgagaccagcatgaccaacatggagaaaccccatctctactaaaaatacaaagttagccgggagtgatgtcacatgcctgtaatcccagctactcgggaggctgaggcaggagaattgcttgaacccaggaggtggaagttgcagtgagctgagatcgccccattacactccagcctgggcaacaagagcaaaactccatctcaaaaaaataataataaaataaatcaaataaaaaaataaaaagcaattgcacagaacattaactacaggcctggcacagtggctcaagcctgtaatcccagcattttgggaggccaaggtgggcagatcacctgaggtcaggagttcaagaacagcctggccaacatggcaaaactccatctctacaaaaatacaaaaattagccaggcttggtggtgcacacctgtagtcccagccactctggaggctgaggcaggagaattgcttgaacccaggaggcagaggttgcagtgagccgagatcgcaccactgcactccagcctgggtgataaagcaagactccgtctcagaaaaagaaaaaaaaaaaaaataacattaactacaaaatttattgttgggcctataacatatagaaatttaatacatatgacaataacaccacataggaggggcgtcagaatgaagctgtattggagtaagaaaacgatacccaatggtaactcaagtacacagaaagaaatggtgagaataaaaaatggtaaatgagaaggttattttttaaaagccataaagatatttatgttctcttttcctctcttctttaaaagatataaggttatataaaatgataattataaaatatattattgggagattgagttctggcattacaatatgaggtgctctgttgactctgtcgcattaaaacaggtgaaccatttaaagcctctggaaatggtcctaagggcaaaacagaaaatgaagaaatatttattgaagaaaatccatagaaatttggtttaaaaaaaaaaaagcaagtctgtggtatctgaacaaaaactgccccctctatcccctctttccctctctccttcttccacccagcctagtgatctggggactccactccacactgctgcagctaagaacacagaactccttctcccctcagctcccagccagcaggctttcttctgaagggaacaggacttcagcatttctcatttgtccctaagctgtctgtggctgagaataagttccaggtgactgaggtcaagagatggggatcctgtcttccatccaatccccactcatggaagagaggatctaccatggtcatggtgtgttatgaacaccagagctccaatagcccttctctcagttctgagattgtagttccacaccagaaaaggcaaaccaagaggacctcaggctagtgacacctctccacctagcactcagctcctacagttgtgaaagtcatgcacaaagtcaagtcagctcctacaattgccattgtccctaccagagcccagagattttacctaaggggagaagcagcctataaaaatggatagctactaatctcttttcagagaggctgacttcatttgcaagagagcatggataagtgtaaacctaaaaacactctaaaaaaaattggaggttatgataaagaaaattgggagtagactcatgaatctaatgaagatacagccaagactataggctggctagtttgcaggagagaattggagaataagacagctggtaggagccttcctgtggtccgaaaaaagtatcaaacactgacctcagaaactatttcctgaaaagagccacactcagattagataaatttgtagaagaattcttgtcctagggagttgttgtaaacaacagaataattggccttcaattggtagaacttaacagctgggtgtggccaaggaaagaggataacagccctgccagtaccaccacagtcattccagggtgattgtgggcacacccaaagttgtgcctaaatgaggggcaacatcaaagatttaagactgcgtgtgtgctggaggggtaaacttcactaaaataatccagccaattactaaacagataagcaaataacaataacaagctccagaagggaagggctagtatccagagttggtaccagaaaacaagagtacactaaactcaaatcaagtagaaggaaggaaataataaaaatcagaacagaaattaataaaacagagaatggaaaaacaatagaaaaaatcaataaaaccaaaaggtagttctttgaaaagatcagaaaactgacaactctttggctagtttgaccagaaaaaaagcaagactcaattactagaatcaaaaattgaagggagaattactactgactttacagaactaaaaagcttataaaggaatactaaggacaattatatgccaacagattagataacttagatgaaatggacaaatttctaggaagacagaaactaccaacacagacccaagaagtaacagataaccttaacaagtgaagagactgaataagtaataaaaagactatccacaaagataagcctaggcccagatatcttcactgctgaattctactaaacattcaaagaggaattaatataaattcttaaaaaactcttcaagagaaaaagcagatgaggaagaaatactttccaaatcatttcatgaggccaatattaccctgactccaaagctagacaaagatatcacaagaaacctatacaacaatgtcttatttatatggatgcaaaaaccttcaagaaaattctagcaaactgaatgtagcaacatatacaaagaattataaaacatggcaagtggtatttatctgagagatgcagagttggctgaacatctgaaaatcaattaatgtaatacatcatatcaatagaataaaaaccaaacaatcaatgaccaccttaatcaacacagaaagagcatttgacaaaatccaatacttcttcatgataaaaccctgaataacatggaatagaagagaacttcctcaatttgataagggcttctatgacaaatccacactgccatcatttaaatgtgtacccccagagcattacattttggaaacttaatcccaatgcaaggtgttcagatgtggggcctaaaaggaagtgattaggtcatgagggcattgcccttatgaataaattaatgctgttatcactagattgagttccttataaaaaaatgagttcatccaactcttgctgtctctcatgcatgccctctctttgcccttccaccatggaatgatacagcaagaaagccctcaccagatgctgcccctcaatcttgaacttcccagcctcaaaaactgtgagccaataaatttctgtttattataaattagctagtctctgctattctgttatactcacacaaaactggctatgatacatataatgaaagactacaagctttccttttaagattagaaaaatgataagaatgtccactttcgtcaaatccactcaacattgtactagatattctagccagagaaattagccaagaaaaggaaatttaagacatccaaattggaaaggaagaaataaaactttctcttttcaagaatggcatgatcttatatatagaaaatcctaaggaatccactaaaaatctactaaaataataaataaggtcaaaaagtttgcaaggtataagatcaatatactgaaatgagttgtatttttatctgcttgcaataaacaatctgaaaatgacattgagcataacaattctatttccaataccataaaaagaataacatactttggaataaatttttaaaaacgaagtacaaaacttacactctgaaaactactaaatattgttgaaagaaattaaaggtctaaataaatgaaaaactacactacattcataaattcaaagacctaacatttttaagatggcagtacttcccaaactgagctatacatttgaagcaattcctactagaatctcagctgacttgtttgtacaaattgacaagctgattcaaaaattcatatgggacccagaattacaagggacccagaatactgaaaacaatccagaaaaagaagaataaagtacgagggctcacacttcttgatatggtttggctgtgtccccacccagtctcatctttctttttcttttttcttatttatttattttgagatggagtcttgctctgtcacccaggctggagtgcagtggtgcaatctcggctcactgcaacctctgcctcctgggttcaagtgattctcttgcctcagcctcccgagtagctgggactacaggtacccaccaccacgcctggctaatttttgtaatttttagtacaaacggggtttcaccatattggccaggctggtctggaactcctgacctcaagtgatctgcctgcctcagcctcccaaagtgctgggattacaggcatgagctgctgtgcccggccccagtctcatcttgaattgtagctcccataattcccatgtgttgtgggagggaccccatgggagataactgaatcatgggggcagtttcccccatactgttctcgtggtagtgaataagtctcatgaaatctaatggttttataggaggtttcctgttttgcttggctctcattctctcttgcccacccccgccgccaggtaaggagtccctttgctcttccttcatcttctgccatgattgtgaggcctccccagctatgtgaaactgagtcaattaaacctccttcctttataagttacccagtctcgagtatgtttttattagcagctgagaacagactagtacacttcccaatttaaaacttatttaaaaacaacagaaagcaagacagtcttgtaatggcacaaggatagacacacagagcaatggaatggcattgagagttcagaaatagaccgataaacctatgtttaactgatgtttgacaagggtgccaagacaattcaatagaaaatgaatcatcttttaaacaaatgttgcagggacaataggatacccatatgcaaaaagacttaaactggatccctatgtcacactgtatacaaaaattcactcaaaattatcaaagacttaaatgtgaacaataaaactactagaagaaaaagcaggtaaaccttaatgacttttgatttggtacaggattcttaggtatgataccaaaagcatgagtagcaaaagaaaaaatagatcaattggactgcataaaatgtaaaagttttgagcttcaaaagacactataaagtgaaaaggcaacccacagaacaggagaatttattttaaaaccatatatctgataagggatagtatctggatatgtaaagaaaattagaactcaatgataaagagaaaaacaagtcaatgaaaaaaaaacagacaaaggatatgagtagacatttatccaaacaatatatataaatggccaacaaacacatgaaaagatgattaacgtggctgggcgcagtggctcacgcctgtaatcccaacactttgggaggctgaggtgggcggatcacgaggtcaggagtttgagaccagcctggccaatatagtgaaaccctgtctccactaaaaaatacaaaaattagctgggcgtggtggtgtgcgcctacagtcccggatacttgggaggctgaggcaggagaatagcttgaacccaggagatggagggtgcagtgagccgagaccgcgccactgcactccagcctgggtgacagaacgagactgtttcaaaaaaaaaaaaaaggaagagagaaaagatggttgacataattagccatcgggggaaaatgcttatcaaaaccacaatgagataccacttcatggctagaatcaaagaatcaggtaacaacaagcattagtgaagatatggataaataaaaaccctcacacacagggtttttatttctccatatcttcatacatgctaggtgctaggaatgtaaaataatccagccactgtggaaagcagtctaatttttatttttattttaagttctggggttcatgtgcaggatatgcaggtttcttacataggtaaacgtgtgccatggtggtttgctgcacctatcaacccatcacctaggtattaagcccagcgtgcattagctgtttttcctaacgctctccatctccccagcataccccccaacaagccccaatatgtgttgttctcctccctgtgtccatgtgttctcattgttcagctcccacttataagtgaaaacatgcagtgtttggatttctgttcctgcattagtttgctgaggataatggctttcagctccatccatgtccctgcaaaggacatgatatcatttctttttatggctgcacagtattcctaccacattttctttatccagtctatcgctgatgggcatttaggttgattctatgtcttcgctattatgaatagtgctgcaataaacattcatttgcatgtctctatagtagaatgatttacattcctttgggtatatacccagtagtgggattgctgggtcaaatggtacttctgcttttaggtctttgaggaattgccacactgtcttccacaatggttgaattagtttacattcccgccaacagtataaaagcaataaatctgttttaaaaagaggaagtaacagtagttactggtgaagaccagtatgtcttgcaaaatgtactttggaaaatgattaagtgtataagtattctgtagaatgaaatatgtactaaagttgcatcttggattttcaaaagaatattttgttgtgtttgcaccatatgtaaacataatacgtataaaataatagacaacagggaaatgaatggaactatataaaagtaaatgtaaaatatattataagaattaacttactataaatatgaagtatattctgataacttatgatgtatatcataagtgccaaaacaaccacaatgagaataacttgaaaatagttgaaaatcattgaaaaattaaaacggtacactagaaaatattcattaaatacaaaaggggatagtaaaggaggtacaaaggaacaaagtagtcatgacacatacagaaaaaaaccaacaaaataaattccaccaaatcaatgacattaaatttaagtggattaaataacccagtcaaaaggcatagactgtcagattggataagaaaacaagatataactgcatgctatctacaagacacatatttatatatttaaatacaaacagattggaagtttaaaaaatggagaaagatgtaccacgcagagtaaccataagagagttgaagtggctatactaatattagacaaaatggactttatgacaaaaactgttatgagagtacaccctcccaagactaaaccaggaagaagttgaatccctgaatagaccaataacaggctctgaaattgaggcaataattaatagcttaccaaccaaaaaaagtccaggaccagacggattcacagccgaattctaccagaggtacaaggaggagctggtaccattccttctgaaactattccaatcaatagaaaaagagggaatcctccctaactcattttatgaggccaggatcgtcctgataccaaagccttactgaaacacaacaaaaaaagagaattttagaccaatatccctgatgaacatcaatgcaaaaatcctcaataaaatactggcaaaccgaatccagcagcacatcaaaaagcttatccaccatgatcaagtgggcatcatccctgggatgcaaggctggttcagtatacacaaatcaataaacgtaatccagcatataaacagaaccaaagacaaaaaccacatgattatcttaatagatgcagaaaaggcctttgacaaaattcaacagcccttcatgctaaaaattctcaataaattaaatattgatgggacgtatctcaaaataataagagctatttatgacaaacccacagccaatatcatactgaatgggcaaaaactagaagcattccctttgaaaactggcacaagacagggatgccctctctcatcactcctattcaacatagtgttggaagttctggcccgggcaatcacgcaggagaaagaaataaagggtattcaattaggaaaacaggaagtcaaattgtccttgtttacagatgacatgattctatatttagaaaaccccatcgtctcagccccaaatctccttaaactgataagcaacttcagcaaagtctcaggatacaaaatcaatgtgcaaaaatcacaagcattcttatacaacaataacagacaaacagagagccaaatcatgagtgaactcccattcacaattgcttcaaagagaataaaatacctaggaatccaactcacaagggatgtgaaggacctcttcaaggagaactacaaaccactgctcaatgaaataaaagaggacacaaacaaatggaagaacattccatgctcatggataggaagaatcaatatcgtgaaaatggccgtactgcccaaggtaatttatagattcaatgccatccccatcaagctaccattgacttttttcacagaattggaaaaaaactactttaaagttcatatggaaccaaaaaagagcccacattgccaagtcaatcctaagccaaaagaacaaagctggaggcatcacgctacctgacttcaaaccatactgcaaggctacagtaaccaaaacagcgtggtactgctaccaaaacagagatatagaccaatggaacagaacagagccctcagaaataataccacacatctacaactatctgatctttgacaaagctgacaaaaacaagaaatggggaaatgattccctatttaataaatggtgctgggaaaactggctagccatatgtagaaagctgaaactggatcccttccttacaccttatacaaaaattaattcaagatggattaaagacttacatgttagacctaaaaccataaaaaccctagaagaaaacctaggcaataccattcaggacataggcatgggcaaggactccatgtctaaaacaccaaaagcaatggcaacaaaagctaaaattgacaaatgggatctaattaaactaaagagcttctgcacagcaaaagaaactaccatcagagtgaacaggcagcctacagaatgggagaaaatttttgcaatctactcatctgacaaagggctaatatccagaatctacaatgaactcaaacaaatttacaagaaaaaagcaaacaaccccatcaaaaagtgggtgaaggatatgaacagacatttctgaaaagaagacatttatgcagccaaaaaacacatgaaaacatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactggaaactcgttcaaccattgtggaagtcagtgtggcgattcctcagggatctagaactagaaataccatttgacccagccatcccattactgggtatatacccaaaggattagaaatcatgctgctataaagacacatgcacatgtatgtttattgcagcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccttcattctcagcaaactatcgcaaggacaaaaaaccaaacaccgcatgttctcactcataggtgggaattgaacaatgagaacacatggacacaggaaggggaacatcacacactggggactgttgtggggtcgggggagaggggagggatagcattaggagatatacctaatgctaaatgagttaatgggtgcagcacaccaacatggcacatgtgtacatatgtaacaaacctgcacgttgtgcacatgtaccctagaacttaaagtataatttaaaaaaactgttatgagagataaataagcatattttataatgataaaagggtcaatcaattgggaagataaaacaattacatgaacatccaaacaaaaagccacaaaagatatgaagcaaaaactgacaaaattaaaaggaagtataggcaactcaacaatgatagcaggggactctaatgctccactttcaataaaagacagaataaccaggcagaaaactaacaaagatgtaggttacttgaacaacagtcttgacttataccaatcagacctgacagacatgtatagagcaccttagcctagaactgtagaatacattcctccaaagcacacatggaacatcactaagataggccatatgttagggtataaaatagtctcaaaaaatgtaaaacaattgaaattatagaaatgtgtgatatcaacaatgaaattaaatgagaaaataacaaagccatttgaaaacatgcaaatatacaaaattaaatacactttttacttctattgtctgctcttttggggtcatatccaaaaaagtgttacccagaccagtgttgtacagctttccccctatattttatggtttcaggtcttatatttaagtctttaatctattttgagttgatttctgtagatggtgggacataagtatccaatttcattcttctgtatgtggacaaccagttttcccaacatcatttattgaagaaactgtcctttcttcattgtatgtccttgatgcctttgttgaaaatcaattgattgtaaatgtatgggtgtatttctgggctttatgtccctacagttggtccatgtgtctgtttttatgccagtaccatgctgttttgattataatcactttataataccggctctcacttatatgtggaatctaaaaacttgaattcatagaaatagagagtagaatggtggttactagaggctgagaaggggaagggaagagcggggaaaggggcaatggggtgttgtccaacaaataatacaaagtttaagatagaagtaagttttgagagctatgcacagcagggtgactagagtcaataatcatattatatatttcaaaataactaagagtaaatttcaaatatctcatgataaaaataataggtaaatgaggtgatatatatgttaatttgttttatttaatcattccacatatatgaaaacatcacattatatcccataagtgtatacaattatgatttgtcattaaaaatattaatttaaaaataaataaaaattaagggcattcttagagtgtgaaatagtatctcactgtggtttcgacttgcatttccctaatgactaatgatattgagcaccttttcatgtgcttttggtcatttgtataacatttttggtaggatgctagctgtgggattttaatagatgctctttatcacgtcaaagaaattttcttatctccctaatttgttgtaggttgttacctgagtgtttcccaggttttttatattacttcatctagtgaaatgatcatgtttttgccttttattccattaatgtgttacatttattaatttttaagtgttaaaccaaactttcaatcctatttatatgttataaacatattttatatgctaatatagttttataatggttgctttctaatctagtgtctttagaaaaagctaaaagatgggagaaaaatacatattataatttttaagaaaaatgtatgtaattataaacaatcttatttgccacttctaatattctttttgtgtatgaaattactctctggtttcatttccttactctattatacctcctttcacttcccccctgctttgtgctattattgtcaatattatactgttttatgctgttgctttttaaatatatgcttatattttcaaatagttttagatttaagacaaatttctaagatactatagagatttaccatccacctcacacacaatgccctatatgttattaacaacttatattagtatggtacatttgtaataattaactaataccgatacacttatatcattaaccaaactccatacttcattcaattttccttagttttttcctcatgttctttttctttggttccaggatcccaaccagcatatgacattacatttagttggcatatctctttaggctcttctttgcagtgacagtttttgactttccttgtttttgatgaccatgtcagtttccagtagtactggtcaggtattttgtagaataatcctcgattagtatttctctgctggtttcttcataattggagtggggttatgaatttttcgggggggggggcaatcacagaagtgaaataccattttcatcacagcatatcaaggaacacactaccaacatgacttatctcattgatgttaaccttggttttctggctaaggtagtgtttgccagctttcttcacttaaattacaattttttcctttccatactgtattctttcaaggaagtcactatgcacaggccccacttaaacagtgagaagttatgctctatgtccttgaggacagagtagtaacataaatcatttggaattcttctgcataaaatgtttgtatggttctccccatttatttatttaacccatatggactcatggacataaaataaatatcttggattataatctattagtactttattgatttactttttttctcaagttgttccagctttggccattgggacctctttcaattgactccagtgtccttttgacataacccattcagtagtgtgtgtgtgtgtgtgtgtgtgtgtgtgcactttagtacttccttacttcctggcactacgagattctccagactcatgtagttcctgatccagtcctagaaccagccattttttcaaggatccctggttcctttcattgaaaaatggtattagaatccaagttctgggcactagttgtgttcactgctgcttcagtatggttttgtttttcaaatcaactaagagaagagggagaaggaatatgtaattacactgtcttaatcactacacaattacctttaccagggctctttatggattcaaattattgtctgttgtcactttctttcagcttgaaggatttctttttatttatttatgtttttgagacagggcctcactctatcacccaggctagagtgcagtggtgtgatcatggctcactgcagccttaacccgggctcaagcgacccccacaccccacctcagcttcctgagtagctcagactataggcacgtgccactacaccccgctaattttaaaattttttgtagagatggggcccactatgttgcccaggctggtctggaactcctgggctcaagcgatcttcttgccttggcctcccaaagtgctgggattacaggcacgagttactgcccccagactgcctgaaatatttctttccgtttttctcataaggcaggtgctagcaacacattctcctaatctttgtttatctggaaacatctttatttcgcctacatttttgacgattagtttttccagatacagacatattggttgattttttttctttacgacttcgagtatgtcctccccttgtctcctgttacccactttttctgatgagaagtcagctgttgaaattactgtgattcctttgtatgtgataagtcattttcctctggctgctttcaggattttccctttggctttgaatttcagcattttgactatgatatgtctaggtatggatctgtttgagtttatcttacttggagctcactgatcttctttgatgtttagattaatgtctttcatcatatttggggattttaagccataatttctgtgactacatttctgcctttttctcttctccccttctggtactctcattacatatatgttgatatgtttgtttcccacacatatatgaagctctgttcatttttcttccttctgtttttctttctctattaatctgtcttctgcttcagtaatctctcttctgcctcttctgccatgatataaaatattgttggccttaagaatttttgttttgcttattttattttcaagtccagaatttgcatgtggttctttttaaaaaataagttctatcacttcattgatattctttatttgatgagttgttatcatcacactttcctttagttcataaaacacagttttctttagttttttggatatatttataatagctgctttaaagtccttgtctgtcacgtacaacatctgagctccctcaaaggtgatttatattgcctatttcctgtccatggtcacacttaacttattttttggcaatgctcataatttttgttgaaaatttgacattttaaataatgtattgtagtaactctgaattctgtttacctatcccacccccataacctgggctttgtttttgtttctgctttttctctatttctcttcagtgtcttgcctggactaattctctctgaagtctatttcatctgtagtgtacagtctctgatgtcatgttcatttctcttcttgttttacttttaagtctggctttctaggagtcatcttatatcaaaaggtcacaggtttttcttaagttcctagatccagtaaagcttctatcttttgccaatgtatctttgtatggattggggaatgctttcatacttcaggaagtctttaattttatcctgcattcaaatagggtttagcagctcataaatatcatatctctggtagctcccacacaggtttagcctagtgtgtgtgtacagccttccagaccaatagacaaatgtgatcttagcagggcatttttaaactctttccacaggtctctctctgaaatgtctggctggtcttttttcttctagctgctactaatatgtaattctctaatattcactactataatctctgctgttttcaacaataactttaggcatgaattccttcatgctctgttctaaagtcagtcagtccccataggctatgttactatttggagctggatgaggagagaatgatatggcagcctgcttcttctacagtgacatctctgctctatgagccccctgaagtccttgtctgacaaaaacaaaaaaacaaaaaaaaaactgggccctcgacttgggagtggggaaataggagccctggtcttctccaactgccattcacagtttgctgcaactgtctagggtagtgccttcatcttaagagtgggaactgagcacggaatgggaacccccaatcttcttgttttttgtggccaagaataaatcttgtacaacagagaactggagatggaagaatgagagtcactagcagcctgatcattctggaatgaaactatagctctataatcaacagctggtaagaaagagaccccctgttttctcggttgtactcacctggaataaatcttctgcaacataaagttgggaggaggaatggaagcagttccttgctcaaatgccaattgttcttaccaaggttccatagatttttcttaaataagtgattctcaatttgttgcatgaccttgagccagtttccagatactttgaatggttgttttacatcatcttctaccattttaatggttgttttactggtgagagggtttgttgagctcttcacactagaagttggtctgtcacaattgttaattcaacacatgtttagcacacacctactatgtactaggtgttatatacactggatttgtttgaattaacagatttattaatgtatagttgatatacattaaactgcacatatttaaagtatacaatttgattatctttgacatatgtaccttctattactataatcaagatggtgaacttacccattaatcccaaaagatttcttgtgccctttgtattgccacccagttttctctgtccccctccctctggtaaccattaattagcttctgtcactatagattagtttttgcacctgtttttaatttacaaagctgattggtggtgaagtttctcttttaccaggggaccaccctcagcccaattgctcttttcttatgagcagaacatttttagagattttctttttgcctctaggtcaaaattactcaagagaaaacaaagaatccagccaccgccatctctgcaaagggagttttagtaaccagctcaccagattcccaagtatatgtttccagacctccaaaaaaggcaacagcatttcactcctgtttgagttggtaaattcaagtccttgcatttaaggagttataggctacagtgtaagaaaagccttaggattcttcccttacagtggagaagggttgagaagtcaccagggttcttctcactgtctttgcttaggtaccagcaagggctattaagcaacccaatgttttcccattgtccttcacatgaatgattataaactcccagcacagtctgagggactcagggtggtccagtttctacagagacccaggaattgaatccccaaactatacacatgctattacttctttcactcttcaagaggaaaatgatatggcaactccagcaggcttagctgttatcaactagaactgatcctaagagcaatgatttattgcttgcctaccatatatcaagcactgggctaggtggtatagaattgttaatctcatttataatacaaccaatccacaaagttggtacaattttttcccattgtacacaagggaaagctgaggtaaaaggaggtgaaaggacttgtcccagatcatattcatagtgactagcacaggagaaactgaaactcagatctgacacttaggttaccctctatccactgtactataatgtcagattgctaagcttagggatttccctccacatcccaaaagcctctcataagaggagaattccaactatatggcttttcatctgtgtggcaataaatgccacctgggaccctgtatttttattgcttttatacaagcctatatcactctgtcagacgaattaaaagtgctaattcacataaatgcccctcttcaaaaagagcatgggaaatatccagaaaacccatgaatgaattcagaatcaggctgtgactttgactgtttacatgacagcgaaccacaaatgctggattacattccaagcatctgtgtttagcaccttggaatcttgtaatattaaaaaaaagttctgacaaatagctatccatggaatgtagaactctaactcagttatgctgtgtcagaaattggcgaagatgcttactgcaatatttttacaagggctatcttacaaaattgaggccagtatgccatcttccagtttgtgctgcatctcatgcaggtttgtcattcattaaaaggctacaaagagattaaatggaatagggctacttggctcaaacaagaaagaattcaagtttaaagcagttactgactctcctcagtagagggcagtggtgggcagggcaagactggcaggaggagaaggggggaacattaatttctgtggtgtacccactaagtgctcagatacagtgcttaatgctttacagacagtatctcatgaatcatgggtattaccctataaaggaaggattattagcaccattttagcctcaaagaggttaaatgaattgaacgcagatctggtgccatctagttcaactattccatgctgttgcctgaaaagtactgctttattctaaagtgtcaaaactggaagcttatactgatgaactgaaagaggagactctcctaggatagagtaggtcccatatatgatagtatcctgaaagatcgaggctggctggaacaatggaaaacatttaacaaagataacatgtaaaaattataaacttcagagccagtgacaaggtggaaatgatctacaagaagtggttcagaggattggaaaactgacatatggggaacagttgagagacttggagaagattagaccaggatgcctggcactagggaggtgttcatacatgttggaaaaactgaatgtagaaaatatcatgagaaacctaacattgtcttttaactacctaaagggcaattagttatcaagaaggtacatactgttttgtgtggttccaaaggctaggacctagatcagctggagggagattttagtttcttaaaaggaataatctactaaaaaacataaaactctaagagagagagagcaactcaaaactgacatgagttgctgtgtgagattcagttgtaaagatgacctccaggaacccttccaactccaggaagttcagattttgtgctgattaagactcccgggatggcttctttactcttgtcaagtgatgttcttaaaactttccaagaaagaactagttggtcccccatacttaggagccaaagtattcagaccattagaattaactctcctaagaggaccttatccacacatctccaaagaaattataggagaaattctgagactgcctcacaagagggagccattgctgttccactggaatctgtatattggaccaattaaagactacaaatgtaccttttattcaaagaaacaaataaacatagtcaaaaagtttagccatttcattaaagatgctgggcccagtggctcacacctgtaatcccagcactttgggaggccaaggctggtggattgcttgagctctgcagttcaagaccagcccgggcaacatggtgaaaccccacctctacaaaaaatccaaaaaaatagctgagtatggtggtgcacacctgtagtcccaactactggggaggctgaggtgggaggattgcttgagcccaggagatggaggctgcagtgagccgtgatcacaccattgcacttcagcgtgggtgccacagtgagatcctgtgtcaaaaaacaatacaaataaaaagagaagaggccactgaaatacacacttataaaatatgataccaaataaagcctaatgatgatggaatctaaagaatctaaccctagccatatcagaataaataagtcagtcactcactcatcagcatttccctggttcatcttattatatgccgggctttgttctgactaatggagataacagagagaagttagaaacaattaccacctttaaaagggtcacagtttagtagtagagagatatcttcatagataatttactccctgtatagagcaatgggaggatagagatctatacaacaggctgtagaaccacagaagtagtagggatggaatgaaggaaaggttatacagagaatatatcatttgagctagaccttaaaaaatagatgagagttcaccatgtagaaagaggaagggtacattctagcaaagggtacaacatgtgcaaagaaaaagaggtagggaagatcttgggatatttaagaaagatagtttgtcaggtatgggttggctagggcataagatgtatgagaaagtggtgaatcaatttcttcatattcttgctatggagagattctctctaaaatggcatgttcagcaagcttaccaactgctgataccctgaactggcttccactgatgaccgcagactgggctgtgcgcttgccactagaaatctggtttttagaagacctccatctactatctctctcttgagggttaccaaagccacagtgaactggaattggacaacagggaagcttcttgaggacctcaacttgaccatagccaccaacacaagaggacagacatctcattatcttggcctcttccaggtggcacttctaggaatggaatgattgatatagaggtctttgctataagctatgcccagatcttcttaccatgaaatcctgagaccacaaaagaatgccatatgtgccagctcacctggccaacatcagttactaaaggcccatgcgtttccagcaggaagtgtccaaagggcttcagtcaggaatccttactcctattatttttttgatacggagtctcactctgttgcccaggctggagtgctgtggcgcaatctcagctcactgcaaccttcgccgcctgggttcaagtgattctcatgcctcagcctcccccgagtagctgggattacaggcgactgccaccacacctggctaatttttgtatttttagtagagatggggtttcaccatgttggccgggctgctctcgaactcctgacctcaggtgatccactcgcctcggcctcccaaagtgctgggattacaggcgtgagccactgtgcctggtcccttcctactattatgacagacccttcctaaagggatgaacttctgaatttgcgggtagcctccttcttaaaatgttcaatgatctcctgtttctgctgctatgcttctcctgaagcagccaaaattccaaatcatttctagcagtagatctgcattgacctcagctgattttaagacctatatgggaagcaatcttatttataatatttatcatccttcatcatcctcaagcaaacgatcagagtgggaaatgctagaaagtagtacagtgctgggcatttaataaaagttctctaaccatagcttgattaaggttgtcctaaaatgggccactagaagatgctggccattaagatttgacaaaacattaacgtatcacttaatatgtcactccatattcaacaataggagtttgtcttgctcagtaaaaatgggatgaaattacaaggcttgccttcaccatctttaactcaaggtttcataaagacatacatatagaaaatgcatttttaaaagcagtattaacttacacctatctttattcttttttgttaggacagttagttttgtcaagagctatgaaacaatgatagaatcctaccactctaatcgaactcatggagtctatgccaaagagagtccacaatgtagatgaacccatgtgatactaccactttggtcaactgtgaaattattgctcctagggtgatgtgacaataaaacaacaaaacaatggaagctttatcttccagaactatcaaggcattgaatcctcagctatagctcctgggggaacaacagagaactagtatttcttcacctaccagtagaactcagacatagccttgtcaaaatggtgtttctctatcactagggcaaaaaaatattagctaaggagctaatgacattctgtacgtcaggaagatctggggctcactgtcagatatttcgtcctttgtggggaaggtttctataataatggtattttgcaacatggggctgtgttgttgacagctccttgtctacatttcttactatccatcatgacactgaccaacaccatcagggaaatacaagatctgctctgaccttagaactgttcctgatcatgcaaaatacattctgtcctgacttcatattagcagtgtttaattataattaatacagttatttctttgttacttgagagtacaagtcatgtgtttctagctaaacagtaagatctaagacagtagtatagggcagtgggaagaatacactttggagtaagacatttccaagtttgaaccccactcccgagctagctatgtaagtcacataagttctgtgagttttagtcccctcatctataaagtgggtaagatgctatcttgacctacaggatggccctaagaatatgtaacgtgcctggcacatttctgtaaatgaaagttactttcccctttcctctgtaccatatctgcatctgataatacaatacaggattttctgatcaggtgttcaccaaatcttgactaaacacagagaaaaaacattttagtccatgctttttgtgcccaatattatagggattccctgtcctgatctccctccagctttaaagccaggtttagtcattcctgactgcacatggttcttcaacagaagactaagtcctctggcaaatttggtccataagcacttcctattctgacagagaagacaggttaagtttcacccacatcttaatcttaaggaatgtgcctattttcttcttttttgatacactagcttagagtcacatatctctggggaaagcagacaacacaatttgagatggccacctgccttacttttcagatgattaattccattagtcagattgccattacagtcagactgagggtatgcctgatacagcttaagggctgaggggttcttcatgaaaaatactactctaccatctctcttttcctttccaccctaaaaggttaaaaaaagaaacttaccttctacaaggaccctctttgaaacatatttctaagtctctaatcaaggaagtctacctaaagcctaagacaactttaaaagccctttatgtgagtaaatggatttcaaatattgtgctctaaaggagaaaaatcaaattccaggttggaatcctcatttatgccagacagcccctgcaactacagggaaactctgtgatggaaattgtcaggtcagctcagtgcctacaggccccattaatttatgtctccttcttctgagaggacatgaaatggggagaatctttttacttgattattcatagctatgcttttggggctgccaactcactctccatactttacatagctgacccatgacagcacacacctaatctcacatagggtcacataccctcacttatatagttatacatcccctagactatagagagagattgggaacctctgagagatggagtgtcttgggagaatagactgcatggtgaagaagggcagagaacagggaaacgagaaataattcccagactattagctagttctttgttggtctttcctctagattacgtaaaggacttgagtggcatgtgcttcttctttgatgaccctgaagtccctaccttaaattgcttcaggcctcagttcacagacactctgcagagatatgtaacctccttgccttggagaatatttgcagaatcaaaatgatgtcctgctttaagagagttactctcccaaatccagtggaggagactctgaaggagcttgaaggactgttaatgttacatcgggttttaatctcataatttgtaacctatatgggtaataatttaaagaacagctttctgcaaaacaaattgttattgggctcactgcagtttatgtgcctttcctcatcacttcacagaaaggtttctaatacatttcagtatacctgggagcaaggcctagcactgagctgtccagtacagtagccatccactagccacgtgtgactaatgagcacttaaatgtgactggtgtaaattgacacacacttgtcaagtttaatatcacaccagatttcaaagacttaatattaaaaaagaacacaaaatatctcattagtaacttttatactgattccatgttgaaatgttaatattttagatatattgagtagttaactaaaatatgttattaacatttgtctcccttgtttctttttacctttttaatgtgattacttgaaaatttaaaagggcatatacgtattgttatattgttttatgtttatgaattttgtcatacctaactcctaaagtttttccttttgctttcggtatttgagatgctcccaagaaaagctagctgtgcagctttgggaaacctacttaagctctccaggccaaatggggctaattgtctatttcataacgttattaatttcataaggatttaatgggctaatgcatacataacgcttatctctgtactctgtacctggcacttagtaaaaactcaacaattgacaggtattctgcccaaagatagtgaaaagcgcttcccaaagaaatgttatacatcttaccatccaggtaacatcatttttctttacataactgctaatgagatccttagctgagaaaaatgtgagaagcctcagtgttggttcctcatggatctctgagatgatgcttggttttaagcagtagccaggcttaggaaggagctacagaactggaggcaaagaattcattctcccatttattcatctatccaatcattcaacacttaatttattgagtctcaagcactgttctatagacaatgggaatataacaataaacaaaacaggcaaagattcctgcccttatagacttttctttctggtaaaaataagtcatagatttgttttcaaaagctcgctccaatcatttatattcggaacttgattcagaaaccactttctccatagacagcactgacctctcaaatggtcattctaggtctcacctaaagcctgtaaggtatgtgttgttccagcatctctgccactccccagaatagtcaagaattactagccaatcaatgcagtcccctccttaggctcaaatcaatcaaaaggtttgtaggctccctccacataccatgcatcagtcttcactgatctcttacctgccacaaagagattaacccactatcctctagtatgtcaaatgggctacaagtgacgtgccaaaccctcaggaagcaaacaatatccacagcactaccaccagaaaagtacattatctcactgtctccactaccagttttgtcccaggaggtatcatggtgcaatgaaagtagcatgggctttggcaccaaaatgaccaggattcaaatcctagctctgcagtgcactgtgacttcaggcagatcattttaactctccattccttcatctgctgtcctgtgaaaaggctatcttcctcacaggattatgggaatgaatatctaacaggcacagtgcctggcacagttagtattccagaagcattagttttcttcccacattccttccaagttgggtggtattttagaaacagcatgaaagctattcttgtatggattaggactaagcaattgcctcttagtggagggctcacactggctagctttccagtgaagtattcagtaatatcattttagcaacttgaaactggccatggtgggagtatatccgctatagaaaccacaagtgctacaaattaggttttacttatttactgtttttctggagagctggtttgccagcactccactagcttaaaccgcaagacacatggacaactcagggacaaagataaggcaattacacacttgtcattttgaaacagagacccttctacagactgggcaaaaattgccatgaaatatagctactcggtccttctctacagaatctttcatgtggcacattaaacatacttattgccccctgaatataaaaaccagcaacataagacacgacaagtatcatcacagggccaagttcacagtaggtgctcagtaaacatctgtcaaatacataaacaagcccaggataaattatttgccacttttcatcaatgaaatagaagcagtggtttgaaaaaatgaaatgagactcaggagaaaagaactttaggatagaggtgaacgcacaagccagaatgctgaatgagaaagttctggaagggtgaacaggctcaaggcaagggaaagttggaacacagaatccagagaaataggtccatggtagtagggtacaggagaggtacatgggggaaactgacaaatggaacaaggtcctgaaatagaaatagaaattcatgagctatactttatctgggaaggaattttataatgttttggtggagatgttctttataaaattatcaaaatttttatcttcttaaaccactgcactttaacaacttaaatatataatttacatatgataaaattcacccatctaaagcataaaatataatgaattttagcatttacagagctgtgcaaccatcaccacaatctaattttagaatatgtccattatcctaaacagaaaccttgtgcaatttatattcagtccccattcctaacacccagccccaagcaaccactaatcactttctgcctccaaagatttgtcttttttgaacatttcatatacaataaatggaatcatacaatatgtggccttatgtgtcttcttccactgagcatgtttttgaggttcattcatatagtagcatataatactgcttcatttcttttcactgccgaacaatattctattgtatgattataccacatattatttatccactcagaagttgaggatgtttggggtgtttctgccttttggcttgtgtgagtcatgatgctatgatatgaacattcaggtacaactttttgtgcagacatatgttttcatttatcttgtgtatacacctatgagtgaaagttctgagtcatacgatagctctatgtttaacatttttagaaactgctaaactgttttccaaagaactacaccattttgcattcgtatcagcaatgtatgagagtgttctgatatgccacatccttgacaacacttatttttgtctaatagatagccattccagtggatgagaaatgtaatctcatcatggttttgattttcattttcctaatgactaatgatgttgagtatctgttcacatgtttatttgccatttatatatattctttggataaatgtctattcaaattcttatcctgctttttaatgtataatctgtcttattactgagttgtaagaggctttatattttctgaatctaaagactttgtatgatatatgatttataggtatagtctctcagtctttgaggtgttatttcactttctggatggtatctttaaagtgtgaaggttttaaattttaagtccagcttacatccagcttatcatgtttttatgacttgtggttttgttgttgtatcttagaaatctttgtgtaactcaagatcacagagatttactcctatgttttcttctaagagttttatagtttaagctcttatacttaggtatatggtacacttttgagttaattggtgtgtatggtgtgaagtcaaagatcaaattcattattttgcatgtgaatattctaccgcctgaacaccaattgttgaaaaaactatttctttccctttgaattttcttggcaagtttgcccaaaatcagttgatcacacatgtaaaggcttatttctgggatctcaactgattgccattatctatatgtctttccttaagccagtagcacactgacttgactattgtggccttgtcataaattttgaaattggccactgtaggtcctccaagtttgatctttttaaagactgttttggctactctgggtttcttgcatttctctgtgtattttagaatcagcttgtaattttctgaaacaaaaaagtcatctcatctgaggccaggtgcagtggctcatgcctgtaatcccagcactttgggaggccaaggtgggtggatcacttgaggtcaggatatcgagatcagcctggccaacatggtgaaacccagtctctactaaaaatacaaaaattagccaggcgtggtggcacagtcctgcagtcccagctactcgggaggctgaggcaagagaatcgcttgaacccgggaggtggaggttgcagtgagccaaggtcacgccactgcactccagcctgggtgacagagcaagactccatctcaaaaaaaaaaaaaaagtcatctgagatttttctagggattgtattgaatttgtagatccatctgggaagtacagccattttaataatattatatcttctaattcacaaacatgggatatctttctacttatttaagtctttcttttctttcactggtgtcttatagttttcagtgtacaaaatacttttttgtcaaatgtattcttaattattccattttttgatgctattgtgaatgaaaatgttttcttaatttcattttcagattattactataaagacatagaattgattttttatgttgatgtcatatcctacagacatgatgaaaaattatgttttactgtataaaatataatattatctatgaataaagacaaattagctttttttgtctaattgccttggatagaatctgtaatgcaatgttgaataaaactggtaagtgtagacatatttgtcttgttcccatcttaaagcaaaagaattcagtctttctctattaagtatgatgctacctgtaaggtttttgtatatgccctttatcagcttaaggaaattcccttctattcctaacttgttgagggtttttgtcatgaaaaggtgatggattgtgtcaaattattcttctgcatgtatgcagtttatcatgttgtttttgtactttattctactaatgcaatgtttacattcattgattttttgcatgttaaaacagccttgcattcctaaggtaaattccacttggtcatggcgtataattatttttacatattgttagattcagtttgcaagtattttgttctagatttttgcatctattttcataaggaatactggtctatagttttcttttcttgtagaatgagttgacgcttatttcctctattttctgggagagtttgtgaagtattggtattaactcttcttttaatgtttggtagaatttattagtaaaactctttggacctgggcttttctttatgggaagatttttaaactactaattcaatcttcatacttgtctgttcaggttttctattatttcttgagcagttttcataatttgcattttccaggaatgtatccattttatctaagttatctaatttgtttgcatacagttgtttggagtgctcctttatactttttaattaatttttctgtaagttctgaagtgatgttccctcctcaattcttgaaatctgtaatttgagtcttctctttgtcaatatattttgttgattgttatgggatgaactgtccatccaaacttcgtaggttgaagccctaactcaacagtatctcagaacatgaatgaatttggagataaatcctttaaagagatagttacgttaaaatgaggctgttaaagtgggctctactccaatttgaaaggtatctttataagaacagaaaattacgacacatattgagacactagacacatgcacatgcagaaaggaaagaccaggtgaaaacatattgaaaaggtgagccacctgcaatccaaaaagagaggcctcaggagaaaccaaacttactgacaccttgatcttatactttcagtctccagaaatgtgagaaaattgatttctgttatttaagccaccaagtctgtggtaatttgttatggcagtgctagcaaacgatcaattttgttgatattttcagacaaccaacttttggtctcatcgattttctatgctgtttttctgctatttcatttatttcaactctagtaattatcatattattggtttccttccactggttttgcatttacattgcaaaattccttctgaatctcctagtttcttaaggcagattaggtcattggttttacattttttcttctttttaatataggcatttacagcttcaaatttccctgtgactactatttttcctgcagtctgtaagttttgatgtgttgtgttttcattttcattaatcttattttcttatttcttcagtgatttattctttgacccactggttatttaggagtatattgtttaattcccacatatttgtgaatttcccaaatttccatctgttgttgacttctaatttaattatattgtgatctgcaaatttactgcatatgatttctattcttttaagtttgttgagacttgttttatggcctagcatatgggtctatcctggagattgttccacatacacttgagaagaatgtatattcttctgtggttgggtggagtggtctgcaaatatctgttaggtctatttaaattattgtgttgttcaagtcctctattttcttgttgatcttctaatcattttatccattattgaaaatgagtattgaaatctccaactattattgttgaattgtctattttatcttcaattctgttaatttttgcttcatgtatttttgggacctgttgttaagtatataaatatttaatatgtttgttatattttcctgattaattgacccttttatcattataaaatatttattttttatctctagtaactttttttttttttttttaagagacaggtctctgtcacccaggctagagtgcatggagtgtagtggtacaatcatagctcactgcagcctcaaactcctgggcccaagcaatcctcctacatcagcctcacaagtagctgggactacaggtacccatcaccatgtctagctaattttctatctttctttagggatgggatcttactatattgctcagaccggtcttgaactcctggcctcaagcaatcctcctgcctcagccttccaagtagctgggattacagacatgaacaagcacacctgacaacatttttttttgttttaatacgtattttgtgtgataacactaacagctactccagctgtccgatggttgcagtttacatggtatatctttctctgttattttagttttaacctatttgtatctttgaattgaaggtacatctctttttgacagcatacagttagacctcagtttttttatccagtctgagaatttctttctttttatcaggttatttactccattcacattcacattattattaatacagttgaattaatatctgccatttgctattagttttccatatgtcgtattttacaaaatattttctgtcccttctttaccgccttgttttgtatgaaataggtattttccaatgtagcattttaatttctttattaaattttaaaccctatttttttaacttttattttaggttcagggatacatgtgaaggtttgttatataggtaaactcatgccatgggggtttgttatacagattatttcattactcaggtattaagcctagtacccaatagttattttttctttttctttccctcctctcaccctccatcctcaagcagaccccagtatctgttgttcccttgtgttcatgagttcccatcattcacctcccacttacaagtgagaacatgcagtatttggttttctgttcctgcgttagtttcctaaggataatagcctccagctccatctatgtttcctcaaaagctatgatactaattcacactcccaccaacagtgtataggtgtccccttttctctacaacctttccagtatctgttatttttttactttttaataatagccattctgactggttaagatggtatctcattgtggttttgatttgcatttttctaatgctcagtgatattgagcttttcattcatctgcttgcttgttggccacatgtatatcttctttttttttgagacggagtctcgctctgtcacccaagctggagtgcagtggcatgacctcggcttactgcaaccttcacctcctgggttcaagcgattctcctgcctcaacctcccgagtagctaggactacaggcctgcaccaccacgcctggcttttttgtatttttagtagagacggggtttcaccatgttggccaggctagtctcgaactcctgacctcagataatccacctgccttggcctcccaaagtgctgggattacaagcgtgagccactgcgcctggcccacatgtatgtcttcttttcaaaagtatctgctcatgtcctttgcctcctttttaatggagttgtttaaactctatttttaaagttatattcttatttattgctctaggaattacaatatacatcttatattctacttcagttttatactaacttaattacagtaagatatttacaaatttgctctactatagctccatttcctccttcttcctttgtgtttttattttcatatatattttgtctatatacagtacaaactcaacagtgcagtgttataattgttgctttaaataatcttatgctgtttgaaggaacaaaaaagaaataaaactatacttataaagttttatgttgagcttcttatttatgatttctggtactctttatttcttcctgtgcatttgagagactacctgatgtcattgtcttgctccactgcaacttccttcccttcagcctactctgtgctgtcattgttaagtatctctctatatgttacaggcccccaattcaattatactgctattgttttgtgctattgtttttaaatcaattaagggaagataagaatatgtaattatgctgtcttttatagttactacataattacatttatcagcactcttagttttttttcatgtggatatgaattactgtgtgacatcacttcctttcagcctgaataacttccttcgatatttcttgtaagggaagtctgacatcgacaaattatctccgtctttgtttatctgagaatgtctttattttgcctatagttctgaaaggtagttttgccagatacaggattcttggttgatatctttatccttcaagcactttgattatgtcatccctttgccttctggtctccattttctttctgatgagaagtcagctattcatctttttggagttcacttgtacattatgagtcatttattttcttgctgctcttatgacttttccttttgtctttggcttctgacattttaactgtaatatacttaggtgtatatctttatgcctttatccttcttggaatttcttgaggattttccatatgtagattaacatttttcatcatgttttggaaattttcagctattatgcattcatttttttcctgccccatttatactcttctccttgcagtacttttatcatgtgtatgttgaagcacttaatggtgtctcagatttctggagctctgttcatttcctttattcttttcttctgttcttcagagtgtataatctctaattatctatcttcaaattcattctttcttcttccagccttatttactgcagagcccctccagtaaattgttcctttccattgttgtaatttacaactccagaattttcatttgatttttcttctataatttctctctttattatctctttgacttgttattttctcattttaggctggttcctttagttctttgaacatacttataatagttattttgaagtgtttgtgtctgtctgatatattatctacccctacaacctcacacgttgtttatattgcctgcttttttttgtacaatggtcacactattctgtttctttgcatgtttcataattgtttgagaactgggcattttagatgatatactgtaacaaatctagattctgattagctttcccaccactaccatggggcttgctgtttggtggtttgcctggactaatcttgtgaagtctaatttccctgcactgtgaaatctccaatgttactgctcagttttttctccttggtttgtttctttgttacctcagagtagctcctgggtcagtataacttaatatttacctagtgattggtcagaattgtgcttatgccccttaagccttaatgatatagaactttgatgatggatttctgtgtggcttggggaatacttataaattggctccatgttcaagcagtgactagtagctctcaagtacactttctggttgcttttgagtcaatgcagtgtagcacatgtgcatgccatcctgacccccagtgatcttaacaggactctttttagctgtctctccccttgattctgtctgttaaacttctggctggtctgccatttaattcgttgcttctagttacatgaactattagcttcctactagttgttcaacataaagatctctaccgtttttgaaaacaccttttaggagtgagtttttccattctctgttccaaataaagtcagccctcaacagcgctgctgacctgccagtcttccagtctttcctaacaccctgagcagaatttttgtcgttccttactggaatgaagatatggtagtagtctgattctacctaagtgatatcaccctataagcaggagctggaggatggggatggtagccccatctttttgatctgtacctcctggtatggaacttctaccctacaagtgggatctggggtggggaaggaacctcagtcttcttgactacgccaacccaaaatagagcttctaaaacatgaagctgagagtggggggaaaaagacactgcgagtggggggaaaaagagcagcctgtctctcttcaggtgaaactgtagtcttatgactaggagcttggcataaaggatgccccatcttcttggctatacctgcccaaagtatagcttccacgacaaagagctgggttggggagaggtgatgacagctagctggacttcctttattcttattgagacctagtagattttcttgaattaattcatctcaatatactgaattccctgaggtcaatttccagagactttaaatagttgttttcaataattttcaccagttaagtggttgcttcaatggggagagaatatgtttagctcctcacacagccattctggaagtcctgctcctaaaccactgatttttaagccttttattatgcttttcttggcttttggaaaccaacttgtattagtccattttcatactgctatgaagaaatacatgagactgggtaatttataagaaaaaaaggtttaatggactcacaattccacatggctggggaggccccacgatcatggcagaaggcgaaggagaagcaaaggcatgacttacatggcagcaggcaatagagcatgtgcaagggaacttccctttataaaaccatcagatcctcatgagacttattcactgtcacgagaacagcacaggaaaaatcagctcccatgattcaactacctcccactaggtccctcccatgacacatggcaattatgggagctacaatttaagatgagatttgggtggggacacagccagaccatatcacaatccatttttagatttgcagatgagttggttctgcttaccaatggtttaatttctgtagtgtaggctttatgtatatagaccaacaaacacaatgcccacaacaagaaagaaaatatttcacaaattcattaggtgtatgctcatatgagtgactacattcaagttaattttcggtctcatgcatatagcctcctcattttccagcagaaagtaaaaatgagttgttttcccataactgaatatccaagatacccaaactttattccatcaagtaccagacatttcattttagtcatgttggtggactcactctaaaatatctccttagtaacttacacaaaggcaggtgattctaactacttgaaagggagaatgaaggattgctaaaaaggaagcaggtacaatatatgaaagacatcacaaactttgccaattatagagatcagtcagacacattgatagacactgtaaagagtataattgatactgccaaggatcccaaatatcaaatggtgcacacatctacctcattcacatttccgtaaactgtctggcaaacagataaacaacagccttccaaatgacatgaactggccgagaaatctatgctgatcatggcactgttatacccttaaactttctgcaggcccaaacaatgaaagaaccaatgcctcctaacatttaaagtctactttaaactagccctaacctttctttccagactcaatctccactgttccccaatttgtaactttctccaaccacatttatttccctttctactaccttcacctggtatgtttccttcaccgtcatcaccctgtcttgctagtctgaaagttccttaacggaagggattgtgttttgtccatctctgcccctaggacccaccacaaggcctgtcagaatattcagtacatttttttaatgaatgaatttctgccatctgaaccatctgaacccttaaatgtcacctccaccttggcgcttttcctggtctcaaatgggtcaagtctctcacctgttgaaattcccacagcttcttgcttctaacctttttaatgatacctatcatagtttcccttgtgctttgttataattatttaaatacctacattattcctgccaccactactttttccctcttcagagaaagagggcgaacaagagacagaaagacacacacacacacaggatcacagtcttaaagagcatgaactttgcctcatttaaaaaaaaaactttcttgtggaacttaacacaatgcttatcacataggagacataggaggagttcaagaaatatttgccaaattgaattgctgaaacatttggatatcagtatggagattttactttagatccatacctcataccatacacttgaataaattccagatgggcccaaaaattaaacacaaaaaagaaaaaaacaccctgggggagtggggaagacagaatcacatatttgtcccagctgttgaggagtggtaaatttctgaatattgaaaaatgaaagaaacattagagacaggatggatggatttgaatatataaatgtaaaaaggaatagttttgcatagtgaaatatgataaagcatacataaaaatgaaagcaataaaattggaaaaatatgtgacaaatataaatgatgaagctgactatccaaaatatagagaatggataaaaatatataaggtcattacccagattttacttgagaagtggtgaaagaagatgaacgaggaaacagcaaattatgacactaaaaaatgaaaagcctcattaaataaaattaaaacaaatggatagtatacttatatacctactaaactagcaaaaaggttaaaaatgataacattcagtgctgcagggatctgtgaaaacaggcacacttatgcagtttaatcttttgggagtacaatctggcaacatgtaacagcagctataaaacagctcataccttttggcctcgttattacacatttggtaagataccagaaagcaataactctaaacagaagaaatgcaatttgtgcagaaccattcacagcatcactttttataagagtaaaaattttaaaataacttaaatctccaataatagaatggctaagcaaaatctggcatgtcaataccacacaatcttatattttcatgtgtaagggtatctgcctattccacattgccaggtctttgcttttatgatttctccatcctgggtgtctgttacttagctgtcactgtgtctatttctagagtaaactacctcctcaaacccacccatcctgccgccccaaattctaatttgctgctgtaactgaggaaatatcaggctcccattaaattaaggaccagtgggtctctctgaggtcaagacatgagggcctcttctcctgcaccatgggctttctggcagctgtttgaaaaatctcaaaggcttcttttttctttttaaacttattaccagagtccaggctgttctctgagcttcaggataagtggggtattgctaaaaaaaatggttttgctttaattacaggctcttagtaaaactgtttgcctttcatgaacgctatgtattgagcaaaactcctctagtccataatagaaatattttcatatggaaacatggaaacacctttgatcaagaaagatagccttaaactttataaattataagttctgtgaatagaattggccatgttgtgattaaaaagaaatctggggacaagtaataacaaatacatctattagagtcatggtaatatgcctactgtcaactaaaatacatttcttaaaactgaggtctttttggttcattacagcttattactgcttcataataataatgtgcttgaatctcacaaatatgtgaaaattacacagtcataattctcatcaaggactcaatctcaaacttactttttaaaaacaaaatgttggttctaagttggaggttttacttaaggccatacatgattagccttcaaaaatgaaatcaaagtagtccccagatatagaggctaatataaacatattagagcctttttgtgaaagacttggataccattcctaccaaagaagtcagtggacacattaaaagcatttcaaaataaatagaaataagaacattctgggtgggtaaagcgattgctggcaatgttaaaagagaaggataccttcattttgagccacacaaccaacaaaacaaaacactcagaagaaatttaagctttgaaaacttggctgtgatgagaagaagatataaaaagtgaagaatttcccaccttaggtctattccctggatggggctaagggcgttaagtctgcttgtatgatgttggaaacaataatccttatagttctgaaagaaatcactaaatgggagccatccttcgagtttggtcattctgtaaattgctttatttcttatatgtaaaacctgtattcaggaatctgtaaatcttttcccccacctatgaacgtgagctgcttagtgcttttgtcagcaacaaatagtgtatacattattaattcaactttaatgggtccaaagattacatatgctgagcatctaaagtaaaaatataatgcaggttgataggcaggaaaggaaagaggaactcatggaacctcagaagcaaaacctagtttcagaatccagatctgctgaggtctggcatcaacagtcttgtatacatttataggaattaggttggcaggttgatagatttctcattaccaaggttgggtttcttgaactctcaggaaactagaagagaatatttggaaaacaatcatgccagcagcaggccaggagggtgagacttgaaggagatgttggctgagccatttcctgagcagatccgaaggaaatgatttcaattattgtcacacaatgggccagatgctccctcttgccctattctaactattctcccagctccaaaacaaagaggaaaggaaggaggggaaaaaaagaggaaaggaaggggagaggaggaagggaatgaaggagtgaagaaagggagggagggaagaaaggggaaggagggagggaggaaggaaagaaggaaaaaaaggaaagaaagggaaaaagaaaagcattacaattaaagcaagaattaacagctgtaataaatataaaggttacttttgcataaaatgaaaatagaaaaggtcagttcaggaaatgttaacacactggctcagtttctctcagttcataggcctgaatcattaggcgtcgcaggcccaataggaccacagctttgttgcttgagcttttatgaggcatatctgtgctggtggcagctagcagactggcagggctacaaactggcatgccctcaggtcataaactaattatggcacaatcattcacttgttctagccattctgccaattacttcatgagtagggttgggcgggacctttgtctaaggcctgctctggaaacaagacctcctgggcttaagccttccttcctgtggagttctgtgggagtctgtagggccatcaatagtctcagtaggccaaccagtctacccttctgccttaataatccactcaccaattattaagtgtctgtgttgtacaaggcccagtgaggaaatgcaaaaataacaacgtactcttgaagggcttagagtctagggttagggtggggaacataagaaccattcaaaacctctgcttaagcccacttgcatatctcaagccctggactttcctgaacagaagggcccttttgaatctagacactgcattagtcatctgagttcattccacatgttctcggggggaataaaaagaagatgtttacttccagagtcagtgtaagcttccatctttttcccaatgatggtggataagcttccctgttctccagagtcataattcaattaaggtcttaccaaagccttcctgtccaagagaagggtcaatcactcttccagcacagcaactcccctgccccaaggactacccccactgcactcaattgaagtgcctgactaggtacactcagaggagatacatccctttatataaaagagccacagacttacaaatagcctcggggagccagcatgcattccaagaaatacatgtaaacacatgaaaaggtatgtacacaggtttgcttacaaacaaagtcagaagaaaagtaaacagattgggagggggaaatttcacagctcagtgagctgaagacctggatagaaaggtgaatgaataagtccaacatactgtgtttcaaggcagcagcatacatacacagtcagcagtgacaactggtttgctgggacaggaaagaatggatttgcagagagaattcaggaaacagtttgaggatcaataggccccatcagtatgccagtgatttcatactaatgcagtcaaggtcccagagtaaattatttccatgcttattactgcttatggcaaacatcacccaattcagacttagaggttcaaatagccctagctccctgacagacatcattgaaaacattcctgcaaggagcaccctttgtaaggtggagcctggccaagtaccaggcgtctgctcctctccatggtcacatagtctcctgctgccttccaccctcatacaggcccccagtctgtttgcattcccacacctggccccaccttctagcagaggccaagagcatcattcttggatgaatgcccagcctttgaagtcagagagaatgcaggctgttagatgaggagatccagattcaagacttctcaacacacacttccccctactcaacaatgcttacaataaagttacgctcaagaggcactctggctgctagaaaaacaggaagccagaggagtgggtaggtcagttaggctctctagactggcctgaactctgtggaatgtcaggctcactagaaagctgaatgcctccactgaaggtgtgaccaaggtatctttaagctggaactgaccaaccacccctgtcttagtaaaaaggtatttctccccaaatctgccttccccaccctcccttcacacacaaagaaagtagccaggccttcagtcttggttctctagagcgcagcagaacaactcaggcagaagcagcttgggagaccttgtgcttctctattcgagtgctttcctaaactgtgtggttggcaaaaaacagatctgaacatttggctggaagcagccatgtttaaaaacaattgtttaatttcaagattgcaagaacctttcttcattttggcagtttgggagagggagtggaaatgtagatccattagaataaacagtaaccatccatttgtgtgtatctgttcatctaggtgtattcatggaaatctgggagaaattaagccttctgccttcttctagcccataaggtcattggtctgccacgcctcctgcaataacagttgcaatgcaataactcatacttacatagcacttgacagtttacacagcatcctcccattcattatgccatttaataaagattaatccattatgtggtgtgactaattccctttgacctaacaattctgctttttctataaatatctcttagtaaaataatcagataagtgtgcaaaggtgtacgtacacaaatggccactgttgcactgtttatattagcaaaatgttaggagcaaattaaatgtcaattaatatggtactggtgaaaatacctgtagtatttatatagtcataaagtgtaatacagtgataccattaaagtgattctgtagatctgaaaagatttctgcaacgtattgttagttgtaaaaacataggctagaaaacattacatataatatgaccttgttttttatgtgtgtgtgtgtgtgtgtgtgtgtgtgtgtataaacatggaagaatgaagtgtgagatatgcatacacctaaatatcaatgcctgttacctctaggaggtaggaatgtggctaattttaattttcttctttaaacttctgtgtattttctaagttaatattaaatcaacaaacattattgcttttgatgatgtggaaaacaataaagctacggtcattttggaaaggagagaaaacatgtggtaacaacaataatagtagctaacatttactgagcagttactatgtaccttggttttaagtacacttatattttgatctcataacagtacttatgaggtatgtaatactgtccccatattagagatgagaaaacactgaagcttagagagtttaagggacttcccaaggacacacagctagaaagtgacaaaactaggatgtaaactgaggtttctgttgactccaaatctcattctcttatttgatgctctaccaccttcctcttctagggccctttctcccttgaagtgctcaaaacaatgtatcaaagccagttattatacttttgattacttacgccagaaagaccccattaagagcataactgtttctagctcagagcaaggtttcaaggaagcagcactattagagcctgatgccaaaacccaggtgaccaaaatcagcaatagctcaaattgaaccttcatcccttaaatctcacaaatgcaaagacagtctttgtttgattcaaacgttttcttcctccatccatccatccattccttcattgaatacctatcatatgctaggaactgtgggcatacaaagatgaataaggcagactccctgccttcagataatgtgcaatctgatccttagtgcatcacaggcccattcacctgagaggcttacttgagaacaaactccaagttgaaatgtgaccaatgaccaaggggccacagcaggaaacttgggaagacagaaaacaggttgccaaattcttctttactacacttacaaagaatatggaaagtaaacatatagatccaattaaccaaatctagcaaacattattgagcaatgactatgtaccaggctctgtgttaggtgctgtcacatatcttatgagtactactattactactattcatactaccattacgaaaaataacaactaacattttattaaatcctcactggtagtgacagaaaccaggctaagtgctttacatacaatgtaagttttcacgaccacaaacctattaacatggcttaaggttgaggcctacctaatatgaaatcaaaatgaaacaaatcaacaaacaaagcatctagaattctccactgttcccttattcaccatgaggtcatcttagagctagaatggtttgaatattcagacacctacataaatacttcccatttgttcatttctctagttcagctcacaggttaacaaacttagagaattactgtatagacttctatgcacaacagatacagtactgtactgcaatacaaaagatttccaggaagagtttcaacgattcatgatttttgtcttatgtgctaattttagtacatgacttagagaatacatgagataataatgatgctataaatagcatatgaccagtaaattataaatgatgccttaatatactaatctcaacaataatcatatcagagaaatacccattgtacaggtaaggaaacaagttcacagaggtttgtcccccattgcttcagtgtgaaaaagccaaggtttaaactatgtctgactgacactaaagcctatgcttcttgcacagctttatgaaaggcactttctttttggcaaatgaattatgtttgagctaaaagcaatgaccagggtaccatcggtgagatagatcagaggagatgaacatgaaggcagatccaaagaagagtgatgaacagaaaaatgacattatcaaacatgggctttggaaaaattaacctgatgatggtgacaccttttccctgaggcaatgtcatctctcttttgaggttgaatacaggcaagaagggctagcctacaaaataagccacttttgcggtggaggtctccaaggtgctaaggcatccacatgaacatcacttgtccccttgaattcccaaactgaggactttagggctacatttttggagttgataaaggaagctagggcctggttccctttcatcagatgtacaaatgtattggttacagagttcacactgaagaagacactccagcctttctagggtctcagtatggtattaggcaacaacaacactcttgttgacatgtccaaaatgtgctatttttcacttaaaccacctacatctaatctcagaaaaaaacaccttgggacttgagaatacatctcttgaaaagcaaaatgccaaggaccacgaacagttccctctatcccacttaaactaagcttgcagaggtacttctccccaaagggcatgttgtcctgttcaagggagactggggagtttctcaaatacttttgcttacttctcaggatggccaaaaattaaggattataatcctcacccaccaggtggccatttatatccaaaaagatttgaagcaccttacaaaaaaattctgatgtcacagggtcataaaattaaaagaaagatttagaaaaaaaaaaaaaacagaaaatgaggttattttatttaaaaaggaaaccttttgtttacatatatgttcatcgaatgttcaaatttgatctgagcttcccagcagccaagacacaaaggcaaacactataggtttcagaaccttaatctgataaaaggaaacaagctaatttatcaggaggcaaactatttatgagcactggattctacatgcaaactataaaaggaaaaaaactttaaaaacacaaaaactgatatttctgacattattttgccagaatatacttttgtcatataatcattccttaaattgacactcatgtcttgaattaccctccccatgtgaacaatccttttgtttttcctcacttgcttcccagtactcctgatgaagggcctgtgagcaagtggtgccaacaccctcctgatgctgctgctttggatctgttccaagtttctggatacttggttgggacctccaaaatgctgagtttagacagcagataccagtttgggcccagaatatttttagggccatgttagtgtcaactaccttaactagcagcctagcttcttagaaatggctgatattgggctctgggtaggacagtcaatggtatctaaagggctctttccactacagctcatatgcctaatggatcagaggtacaaaaataatcagcacccagcaagcgaggtcagagtcaggctcagtttggatcaaagatcatactcaggagcgaagaatcctaggcatgaatacaaagagggaggtctgggggaagggttaaccagtagacagtccagcttccaggaagagtactggggtaagaattacaggctggaaagaatgtttggcttcgatatggaaagcccttaacgcccacccaagtgaccaagaggtggggcactctgaggcaagcaaagagaaagaaatggcatgctcacaagggcaggtaagggggatgttgaagaaacagagtctgggaagtaaaattctgaatagcctgatgaaaaggacatttttacatactcatgttatgagcccaacatctgacttgggtgacaagtaaaaggggatactgttaagagccaaagtctcacccaggtgtgacatatgagggaactggtgcttaaccaaagctagagaagcagtggaaggtgtggtatggcaaaagccaggaggaaattccagtaagaaaagaatttgcactcaaccgtaagccaaatactggcatcatttcatttaattctccttacaacaatcctgggacttaagtatgattgccgttatgacatgtgaggaaactgagatacagggagttgcttccctgaaattgctgaggggcaactgactaggaaagagcacttccagcctttgagccagatgtctgtggctccaaatcttgtagtcttccaattcaatggctgctaaacagagccagccctatgtaactaagaaaccaggcccccaacactggggcgaggggcagcagcacctttcccctggcagcctagtaccagagaaaagctgctttcctgaagtagggccaatcaaaattggctttctaggctttgttaaaatcctacctattgtgttatttctaaatataacatatatacacattttatacatatatatacgtatattttaaccttttatttagacaatatctaataataataatacaaggtagtattgagcattactgtgtgccagacacagcaccaaatgcttagtggcttagatcatctattcacatcagaaaatctacatataaataacactatctgcaattcacagatgaagaatgagggtgaataacttgcacagggtcgcatggaaaataaatgacagaatttccatttaactctgtctgcctccagatccatgctacactgccttcctacctctttgatatagataccacaaaaatataaattagcagaaagaagaaaacaaaagcatccacaatatcatttacatatctgctattctctaaagactttttttctttttttttatttttttttgagacagggtctggctctgtcacccagactggagtgcagtggcatgatcatggctcactgcagcctcaacctcctgggctcaagccatcctcccaccccaagctcccaagcagctgagactacaggtgcacaccaccacacctggctaatttttgaattttttcgtagtgacggggtttactatattgcccaggctgtctcaaactcctgggctcaattgatcctcctgcctcggcctcccaaagtgctaggattacaggtgtgagccaccgcaccggcctctctatagactttcaagctacataaactagtgttttgatttgacctgttccttcataatcccacagctctttccccaaagagctgataaggcaagaactaggcatttatttagtttcccctcactgttttaccccaatgggtagtcacacctgttgctgatggaccagaatgaggagacccaagatcagtgatgacactagaatgcaggagaattttccaagacattacttcctgagcccgggagcccagtgggagttcactgtataatctgggacaatgagatgcttaggtaatcacctcaagctggagactgacatgatcctttatcaagcattaaatcagatggctgtaaatagataagaagactttttaaagagttggtaagtttttaagtaaattatcagatgtttaaatgaggatgtatatacaaagatgttttctacaatgttatttataatagcaaaaaatgaaaacctaaatgggcaattacatggagctaataaattaaactataatgcattcatatcatgggttattattatgcagtaatttaaaattaaattttcaaaacaatcataatgacaagggaaaagaaccataataaattaagtggaagaactggagggaaggatacagacaatatgaccaggagtgtgatctcaaatatatattacttttataatcaaaatatattactctgttaatgaaaaaaagtcaattttataaaaaccaagattaataattctgaccctttccacagtgtttttgctcttacaattaggttcgctttttctcataaatggttgaagttgctgctttcatttgtaaaatgggtgtgaaagtaattactaatctcccacagtttctgtgttgatgaaataagatgatggatgtggaagtgatttctttttcaaacattagagtgctagtcacttctgagctatattgctgaggaaatcctacatgtgctgatttttttggtgttctgtagtaatcaatctttcttaaagccagggcttcctgcccatttctactgccatcatcacacttcaggcctttaccctcccattgcctgaacttccataccagtcttccagctggacataccccagtcttctggtctcctctatccaccctccacaatgtatcaagaatcagctttctgaccatgttaatcctttgctcagactactgcagactcttgagtacccttcacatatcacactaattttttagccaattattctatgacattcttcaattatcacccaagttcccatataatcagctaaaagtgttcaacatgttttgcttaactagaaagcactgcattacgtagtagaccctcattgcaagttatctattggtaagtggcaatgtggcaccttcctactcgaagtgtgatctctggaccagtatcatcagactcacctgggagtttcttagacagacattatctctgactccacccagacctactgaatcaaagagtgttccctaggtgatttgtatacacagtaatatttgagaaacactagtctagaaggccctaaagttggcagatggagcaaagtgttcacagctttttcacagatttattgactcattccaaactgtccttgtgtctttcacatatgtttattcatcccctttcttagatgtaagatcattaaaaagtattaacttaaatcttcctcttcctttgtctcaacttctaccatccatgccctcaataagtgctcatcaagtaaaaatagttttaaagaccatatttaaaagtaaccataaaacttatttattatagcatagtggttttaataaagggaatctggagcttgccagcctgagatcaagaatcactttccgacacttcccagctacatgaccttaggcacattacttggcctatatgtgcctcaattgcctcatccgtgaaatgaagatactaataatatccacatcaaggttgttgtaagagttaaatgagtagagagatgggaaactcttagaacagcatctggccgagttaccactgtataagttttaggtattaaatgtttttagaaggtaattataataagtatttcaaaacttaggccactaataatcataaatatagaattgttccatgacagactgcgtgcctgaaatttaagtctctggtgtctgcatactcttattgaattctcacaactcctcagcaagattaatggtaatcttattttacagaaggcaaagtttacacagcttgacttgacttcaggtctgagggatttcagagtccatgttccttataagaagagggctttatagacaacagagaaaagaaacagttgattcgaagatgtaatatagaatgaggtaaaagttgatggtttgactattttgggtgcccagatttcagaaaagaaggattagcattgtaagaactcacaagcttagtgatacaaataattaaaatagtactgtggatattgcattcagtgacttaaacatgaagtgaacagtttgtaaagagcaagccaaggataatcatctgggtctctgggattttctccatcaggatttcaggccaataaatggttaatggaaacctgtctacatccccagctacatagactgcccctgtacaggaagtatgtacagatattcctaagctagaatcagggaatctggaacatgcaggaagaagaagagagtctcgcaatgtgcctccaacactcctctcctggacattgctatctctggttcttccttcctgccctgggaattcacccagtcaccatctgcaaaacacacactgctgttaagagaagtcagagggggataatgcttgggattagggccagagctaggaaaatagtcctcttcctggaaggacattcctggaaggggaatgtggggagtggtggcctttgggattcttccaaattcatagcaagcggtggcagcatctagtggagagaataggcccaggggccagaggcacagctgaagctcccagcatggtgtttggcgtatcagtgagaacctctttgtgtggctgttaggtaataaatcccttgggtaaaaaagtatgcaaaagagtcttgagtcagtcagtcccatttattacaagaaaggaagagaaatagacactgaattatctatgcatacagatgagatattttagccacctaaattaataagataatttttaaaagccaactaagtagtaggcagagttcatggcatctagaatcaacaatatggtataccaagcaaagggtaagaaagtagggaaaaaggaaaattgcattgcaacctcaaaggatgctgcagctgaaaatgagtcagtgatggcagtgataagatacaattggaaaattcaaatttaaggagttggagaaacaaaggtgagttctatctgaaaaggaaatcatgaaaagtgctattaatgaaatcacatggcatgtaaacagtgcataaagtcccgaggctgagggagtaaatgagaacctaagctccacctgccaagtctcatgcctcaaaacagggctgaatccacctgcagaaaagacagtctttctgtaattggcacaaaagcactatatgggttagtagcaaccctgtagtctatgtcttcaggggatttcatattgataaaaactaggactgtagagacaaacattaaacttttggccccaaatagatccagatatttcatctttcatttctaactcactcgatctcttttcaagtatttatagctggatataagagtttcacttgataacctaaaatccaaaactcccaacagagttatggtctttggttaatcagagttttccagagaaacagaactaaaaggatataaagataaatataggaagggagatattatgagggattggctcactgattatagaggctaaaaagttccatcatatgccctctgtaagctggggggaaagccagtgttgtggttccagtccaagccaaaggactgagaactaggacagccaaaggtgtaagtcccagtctgagtctgaaggcctgagaagtaaaagcaccaatggtccaagggcaggagaagatggatgcccagctaaagaagagagagagagaatttgcccttcctctgccttatttttttcctatttggatgggacccctacagatcccatgatgattgcccatattggtgagggtgatcttctttattcagtctactgattcaaatgctagtctcttccagaaacaccctcacagacacacccagaaataatgtcttaccagctatctgggcatcccttagcccagtcaagttgacacaaaattaaacatcataaccaccatccaacataatttgttaagctccatattacactcacgaagggaaaacaaatgttggaaccagaagttttaaggctgaaagggtccacaggacacttccagggaggcttttgtctgaccctgactacttacgcatatatgctgagaccaagaggcctcccagctattccagatacagactcagaggcttagcagggacaattataagataattaatgccattttttttaaggatggggagtgggggggatgcagattctgtctctaggaatatgggctccaagctatcagctccgaacaaggaaagagatatgaaagtcactgtagactgtttcctgaacacaccagcccaaattgctatttcagccaaaacaattatcggtctagttagatcagaaacagaaagaaaaaaaaataaagacagaaaatactctcttccctcactccctcacctcatcctgcccctaaattccctcttcatggtttgctctcacctgggatattgtgtacaggtctggttaccacatctcagggacaatagcatcaagctggagatcttcatatgaaaggcttaaaaatggtcaatttaaaacaaataaaatgggccgagcgtagcggctcatacctgtaatcccagcactttgggaggccaaggcgggcagatcacttgaggtcaggagttcgagaccagcctggccaacatggtgaaaccccatctttactaaaaatacaaaaattagcctggtgtggtggcacttgcctgtaatcctagctacttggaaggctaagttgggagaatagcttgaacttggaggcagaggttgtagtgagctgagatcacgccactgcactccagcctgggtgacagagtgagaatacatctcaaaaaaaaaaaatctaataaaattaagtccaactgtatacaattagtaaacagaaagcacatcactcccatggtttaaaacagcttgactatataaaccattttttttaaggtttggataaattagctgatgagagacactaaaaaggaaattaatgtcaggaggacaaccattacttatggatgttgactttgtgaaataggaggagggcccaaaagagaaacatataggggctataattctgccaggtcctgtactagaaacattatccacattatctcatttaatcctcacaataaccctctgagtatgtactgttacaatctccatattattgataaggaaactcaggtttaagagaagttacatagtgaaaacaatgtaaatatcctacaatagatgaatgagtggaaaacaaaaagtgatgtatacatacaatcgatacacacaatgggatagtattcacccttaaaaaggaaggaaatcttgcaatatgcaacaatgtggatgaatcttaagtaaattatgctaagtgaaataagtcagtcacagaaggacaaatactacatgattctacttatatggaatatctaaaatagtcaaactcatggaagcaaagaatagaatggtgactgtcaggggctgggaagaaggggaaatggggagttgctaatcaacaggaataaaatttcagttatgcaagatgaatgagttctagagttctgctgttcaacattgtgcccataaataacaatactatattgtacatttaaaaatctgttaagtgaatagatctcacattaaatgttcttaccacaataaggactaataaaataataaaataaaatgagaagttatataacatccaagtcacgtacagctggttaaaatgaggtttggatacagattgcaaaggaagtgaaatcatctttatttgtagatgatatgatcaggcaggcagaaaattttaaggaatctagaaaaagtttactagaactaataagtgagattggtaaggttgcaggacataaaactaatgtatataaatcaaacatatttctacatagtagcagtcaaccatcagaaggtgaaattttaaaatataaaccatttctaataacatcaaaaatatgaaagtacttagagataaatttggcaaaagatgtacatgacctagagtgaaactacaaaacatggctgagataaaccaaataagatttaaataaatggagagatatacattgttcctagattagaaaaatcagtactgctcaggcattaattctcctccaaactgatctataaatacagcacaaacccaatcataatgccagcagccattttaaatagaaattgacaagtcgattctaatttttttttttttttaagacagagtcttgctctgtcacccagcctggagtgcagtggcgtgatctcagctcactgcaacctccacctcccaggttcaagtgattctcctgcctcagcctcccaagtagctgggactacaggcatgtaccaccatgcacagccaatttttgtatttttagtagagatggggttttgccatgttggccagtctggtcttgaactcctgacctcaggtgatccacccgcctcagccacccaaagtgctgggattacaggtgtgagacaccgtgcccggccagattctaaactttatataaaaattcaaacaaggaatagccaaaacacctttaaaaagaacaaagttggaggacttatacgacttgatttcaaaacatattataaagctacagtaatcaagacagtgtggttttggcataaagataaacatatgggttaatgttacacaacggcgtcgccaaaaatagatccatatgtaaaaggtcaattgatttttgacaaaggtaccaaagcaattaagtagaaaaaggataatctttgtgttttgttttgtttagagatggggtctctctctgttgcccagactgaggtgtagtggtgtgattctagctcactgcagccttaaagtcctaagctcaagctatcctctcatctcagcctcctgcatagcaggactacaggtaggcactactacacccagctaatttttaaaaagtggttttattttgtttttgtttttgtttttttgtagagatggggtcttgctatgttgcataggctagtctcaaactcctggcctcaagcaatcctcctgcctcagcctcccaaagtgctgggaatacaggtgtcagtcaatgcacctggcctggaaaaggataatcttttaatcaaatagtgctggaacaattggatgttcatatgcaacaaatagtgttggaataactagacgtccatatgcaaaaacaaacaaaacccaaaaatcccttagctcttacttcacaaaacatacattaacccaaaatggatcctaaacccaagtgcaagagctaaagttatataacttctagaagaaaatataaaagaaaaatcatagttacatcggttaaggcaaaaatttcttaaataggacacaaatgcagaaattataaaagaaaaaatcattaaactggactttatgaaaattcaaaattaaaacattttacttttcaaaagtcactattaagaaatggaaaggcaagccacagactgggagaaaatattggcaaatctcatatccaacaaaggacttatatcttgaataaaaaataactcttacaactcaatattagtattacaagcaataaaaatgtacaaaagatttaaatagacacttcactaaagatgatatacatatggcaaatacacagatgaaaagatgctcaacatcattagccattagaaaaatatacattaaaactacaaagaaattccaatacatatctattagactggctaaattaaaaaaataaaacttaccataataagtgttggtgagaatgtggaggaatggaaccctcctacagtattgacttaagatgtttacaatcacttgagaaaatgatttgacagctttaaaaaatgataatgatatacctaccatatgacccagccattctactcatagatttaaccatgatgagccattctattcatagatttaacaaagaaaaatgaaagtatatgttcacacagacttatatgtgactgttcatagcagctttattcataatagctatgaataactattcataatagctatgaaaaactattcataatagccagaaataatgcaaatgttcaccaggtgaatgaataaacaaactatgatatatctatgcaattgaatattactcagcaatattaaagaacaaactgctgatatatgcaacaacatagacagatataagtataattatgctgagtaaaagaaggcaaagaaaaatacacactgtataattcgattggcataaaattctagaaaatgcaagctactgtagtgatagaaagcacatcaatggttgcctgggggttgtggagctggattacaaaggggcacaaggaaacttttgggtgtgatgaacatgcttattatcttaattatggtaatagtttcacacacatttcaaaactcatcaatttatatacgtatttatacatgtatatccatgtatatcttattgtacatcaaatatatctcaataaaatgtaaaattaagtcaatttgcctgaatatcatagtgaatatattaataaaataagactaattttccaaacaaataaaaatcagtatcctgagtgacatcagcaagatggaatagaaaaccctcaactctcctaaccacatgaacaaacaaattcaacaacaaaatatagacaaattccctttttgaaaaatccagaaactacataagagactcctgtacgatgagactaccacattaaagccagcagggaaatctgagagaccctgtcagcataataacttccccctgtacagagccatacaattgggaagaccccctcaccagattccaaattctccctaggaagggaaggagttagaccacatgtccagtgccccaacttttccaggagctgtccagaagattggcttcagttttgcctgtctcagagtgatgatgggacctagcacctagccaccttggaaccagagatgagagacagtatgttaggctagcagttgctataacccctcttcccagcttagcacagagccagcagatgaaaatccctagctcctatcttctctctggtgaggaaaggagttggaccacgtgtcccgtgctccaaccttttttgtgggggatgcacaaaggactggtttatgtcttgtttgtattgaagtactgacaggacccagcacactctgtttcaggaccagtgtgatcagagatggcggtttggccttgcagttaccctgctaagaacaaagaaagtagggtggaatagcataaagctttaaaaggccccctaaatctctagctggcctgactgatgagggtcttctcctgtataaggctaggccatgaagactgggataggtagccatttatttaatgaacagatactcacacaaagagccaagggacatgaagaaacagggaaatatatcccaaacaaagggacaaaataaatgtcctggtatcataaattggagatatatgatttacctgacagccaaaactaacataaagatgttcaaggaggtcagaagaacaacacatgaacaaagtaaaaatttcaaaaaagagatataaaatatatatattaaaaattcaggctgggcatggtggctcatgcctgtaatcccagcactttgggaggctgaggcaggaggattgcttgaggctaggagtttgagaccagcctcggcaacatagtaagaccttgtctctacagaaaaaatttaaaaagttagccttgcgtggtggcactcgcctgtagtcccagctacatgggaggctgagatgggagatcacgtgagcccaggattttgagtcaacagtgagctatgattttgccactgcacaccagtttgggcaacagagcaagaccatgtctcaaaaaagaaaaaaaaaaaaacagaaatcttggagctgaagaatataataactgaaccaaaaaattcactagaggggttcaacatgagactcaagcaaaagaaaggatcagcaaagttgaagacaagtcgttggtaattatacagtcagaggaggaaaagaattacagagagtgaagaaagctaaagggacttaaaggccatgatcaagtagaccaatatatgcattatggaagttccagaaggagagtaaaaagagaaagagttccaaaaagcttattcaaataaatagttgcaaaatactttgcaaatctaggaaaggaaatgaacatccagatccatcaggctcaatagatggcaaataagataaactcaaagaaatccatactaagacacattataatcaaattgtccataggcaaagatgaaaagagaagtttgaaagtagcaaaagaaaaataacctgtcatataaaagaaacctccaaaagactatcagtggatttctcagctgaaaccttgcagaccagaagatgatatattcaaagcgctaaaagaaaaaaaaaaaacccaccagcaactaagaatactatacctgtcaaaactatccttcaaaaagatgaagagattaagcttttgccagaccaaacagacaaacaaaaaaacccgagagagttcatcaccaccagacttgccttacaagaaatgataaagagttaaagggagttctttgtgttgaaatgaaagaacataaaataataatacaaaaaatacagacaagtgtgaaattcactggcaaagttaaatatataaacaaatacagaatgatgtaatgctgtgatagtggtaggtaaaacatttttaattctagtataaaatttaaaaggcaaaagtgttagactgtaaatataaaatatgttaatgttaatgataaaaataaaacgataggtaaattgtgacattaatagcataaagtgtgtgaaggggaaactgtagtttttgtatgtgatcgaagttaggttgttaatcagcttaaaatagcctacaataactataagatattttaatgtaaactcttctaactacaaagaacatacctattgaaaatatacacaaaagaaaaagagaaatcactcaatacagaaatcaaaacacaaaagaagacattacaaaacaagaaaaaagaattataagacagacgagaccacggtgaaaccccgtctctactaaaaaatacaaaaaattagccgggcgtggtggcgggcgcctgtagccccagctactcggagaggctgaggcaggagaatggcatgaacccgggaggcggagcttgcagtgagccgaggtcgagccactgcactccagcttgggtgacaaagcgagactccgtctcaaaaaaaaaaaaaaaaaattataagacagaaaataataagcaaaattggcaatactaagttcttctctattaataactactttaaatataaatgggttgactcccaaattgagagatatagagtgagtgaatggatcaaaaaacaagatccaactatatgctgtctataagagattcacttaagttttaaggacacacaggctgaaagtaaaggaatggacaaagacattccatacaaatgctaaccaaaaaacagcaaggtggctacacttatatcagacaaaataggccaaaaactgtcacaagagacaaaggacaatgtgcaatgaaaaaaggccaattcacaggatgatataagaattgtgaatatatatgtacacaacattaaaccaccgaaatatataaagcaaacattgacagaactaaagggagaaatagatagcaatactataatagtaggagacttcaatattctactttcaatagtggatggaacatccagacagatgatcaaaaggaaacagtgaacttgaacaacactatagatcaaatggacctaacagaaacatagaacattccacccaaagcaacaaaatatacattcttttcaagtacacacagaacattctccagaatagatcacatgctaggtcacaaaacaaactgaagaagattgaaatcataccatgtatattttctgaccacaatggaatgaaactagaaatcaatatcagaaaaaaaactggcaaattcaaaaatatgtggaaattaaacaatacactcctaaataaccaatgggtgaaacaaaaaaatcaaaagggaaattagaaaatattttgagataaatgaaaaacaaaatagaatgtacaaaaccgatggaatgcagcaaaatcagtaccaagaggaaaattatagtgacaaatgcctacattaaaaaagaaaaatctcaaataacccaactttacacctcaagaaactagaaaaataaggaaaaaaagctaatcccaaagttacttgaaggaaagaaataataaagattagaacataaataaacaatacagaatagaaaaataatagaaaagatcaacaaaatgaagtgttaattttttgaaaagatcaacaaaattgacaaacctttggctaggccaaggaaaaagagaaagatacaaataaattaaatcatcaatgaaagagaagacattacaactgataccacaattacaatcatgcatcacctaacgacaggattatgttctgaaaaatgtgtcataaggtgatttcatcactgtgtgacatcacagagtgtacttacacaaacctagatggtatagcctattacacctaggctatatgatagagcctattgctcctagtctacaaacctatacagtatcttactgtattgaatattttatgcaattataccacaatggtaagcatttgtgaatctaaatatagctaaacatagaaaaagtatagtaaaaatatggtattacaatcttatgggaccactgtcacataagtggtctgtcattgattgaaacatcattatgagatgcatgactgtatatgccaacaaactggaaaacttagaagaaatggataaatttttagaaacatatgactgaccaagactgtcacaaagaaatagaaaaaaatctgaacagacctgtaactagtaaggagactgaattagtaaattaaaaatctcccaataaagaaaaacccaggaacagattactttactggtgaattttatcaaatatttgaaaaagaattaatgccaatccttctcaaacgctcccaaaaattgaagagaagggaacatttccaaactcattttatgaggccagcattatacctgatacagataaggacactacaaaaaaagaaaactaaaggccaatatccccaatgaaaactgatgcgaaaatcctcaacaaaataccagaaaactgaattcaatggcacaggaaaaggatgatactctgtgaccaagtgggatttatgtctggtatgcaaagatggtttaacatatgcagatcaataaatgtgatacaacatattagcagaataagggataaaaagcacatgatcattttgagatacaaaaaaagcatttgacaaattcaacagcctttcataaaaagctctcaacaaactagaaatagaatgaaattacctcaacaaaataaaggccatataagaaaaccccacagctaatgtcatactcaatggtgaaaagctgagtttttcctctaagatcaggaacaaggcaaaaatgcccactcttgccacttctgttcaacatagtgctggaattcttacccagcataattaggcaagaaaaaataagtaaaggcatcaaaataagaaagaaacaagtaaaattattttttacttaccaggtaacatgatcttgtatgttgtcagataacatgatcttatacggagaaaatcctagacactccataaaaaaactgttagaactaataaatccagtaaagttacaggatacaaaatcaacatgcaaaaatcaacagtgtttctatacactaacaatgtactacctcaaaaaaataagaaaacaatcccatttactatagcacctaaaataataaaatacttaggaataaatgtaactaagaaggcaaaagacttgtatactgaaaactataaaacattgatgaaagaaatcaaagacacaaataaataagacattcatgctaatgaatgcaagacttattgttaaaatgtccatactacccaaagtgatctagaatcaatgtaatccctatcaaaatcttaatggcattttttttttgagacagggtctcactcttttacccagactggagtacagtagcatgatcaaggctcactgcagccttgattgcccaggctcaagtaatcctcccacctcagcctcctgagtagctgggactacaggcatgtgctaccatgcctgactttttttttttttttttttttttttttgtagaaacaaggtctcactatgttgtccaggctggtcttggaatcctaggttcaagcaatcctcttgcctcaatctccaaaagtgctgggaccctagtggcattttttacagaaataggaaaaaaaaatctctacaattcagagggaattgcaaagaacttcaaatagccaaaacaatcttataaaagaaaaagctggattccctgatttcaattgatattgcaaagttatagtaatcaacagtatgtacatatagagcaagggcacagaagagacagccccaaaataaacccacccatatacgaccaagtgatctttgagaagggtatcaagactacaaaatggggaaagtatagtctcttcaatgaatggtatgggaaaactggatatcaaaccactttcttacaccatatgcatacacataagacctgaaactgcaaaacttgtagaagaaaatgtgagggaaaaggctcttgacattagtcttggccatgggttcttgaatatgatactaaaagcacaggcaacaaaagcaaaaataaacaagtgggacaacatcaaactaaaaggcttctgcacaactaacgaatcttttaacacagtgaaaaggtaggctgggcatggtggctcacgcctgtaattccagcactttgggaggccgaggctggtggatcacccgaggtcaggagttcgagaccagtctggccaacatggtgaaaccccatctctactaaaaatacaaaaaaagaaaattagccaagtgtggtggtgaacacctgtaatcccagctatttgggaggctgaggcaggagaatcgcttgaacccgggcagcagaggttacagtgagctgagatcatgccactgcactccagtctgggtgacagagcaagactctctctcaggaaaaaaaaaaaagaaaaggcagcctatggaatggaagaaaatatttgcaaagcatttatctgataaagggttaatatccaaaacatataaggaacttatacaactcaacagcataataacaaaatccagttaaaaatgggcaaaggacttgagtaaacatttctccaaataagacacataaacagccaacaggaccatgaaaagatgctcaacatcactaatcattaaggaaatgcaagtcaaaaccacaatgagatatcacctgacacctattaggatggccattttttttgagaaaagataagtgttggatacggagaaactggaacacttgtacaccatgggtaggaatgtaaaatggtgccactgctatggaaaacagtatggaggttcctcaaaaaattaatactagaactacatactagatccagcattcccatttctgggtattcatctaaaagaaatcaggatcttgaaaacatatttaaaaccccatgttcattggagcattgtttataataaccaagatgtagaatcaacctaaatgtccatggatgaaagaataaagaaaatgtggcataagacacaatgaaatatcattccagaggaaatcttccaatatgcaacaacatagataagtctggaggacattatgctaaatgaaataagctggtcacagaaggacaaatattgcataattttgcttatatgacgtacctaaaatagccaaactcagaagcagagagtagaatgttggttgccaggagccagggggagagggaaatggggagttgctattcaaggggtataaagtttcagtaatacaagatgaagatgttctacaaatctgctgtacaacattgtgcctatggttaacagtgtggtattgtgaacttaaaatcctgttaaaattgtagctctcatgttaaatgttctcactacaataaaaagtaagttagatgaatgtaaaattttaacaagacatatgaatatactttctgacatcgaaaatacaaaagtaaagactggagaaaaaaatcagtatcattgctttttagtcaaattttatctagtaggcacaacccattttggaagaggagactatctaatgactcccagacccttctaatcctgaagattttagtaaaaacaataaagggtcatgaatgctgcacgctaatgtatattgcagtaactagtatcacccttctggagaacagatttcaggtgatatctaaaagaaaagaaaaaagaggggttactaactttggcttttttgaatgatgaaattaaagcagggctacctggccttaagtctttcaatagttaaaaactaatcttggggctttttaattcatttaagaagtcataaccattatacaagaaagtagaaggaaaaaaaaagatgtgtggttcccatatggttcagtaataatcacaaccagtctatgacttccttaaagagtctgatgaaatatgtgaagggagaaaaaaaggggccctgtgaaagttgtatgggttggggtgggggttgatgaagatattatggggccagagagagaaatcaagagcacattttgtactttacaaaaccaagttagacaccctgaggtaggtggcttatacttatgtaaaataccagccagtgcatcaacataaatttgtaaagtaaccactaatgatttatagtcaatgcttagtgaactagaacactgcaactggagctatttaactttttttaacttctgaaatataattaaattggtacacattgaattaacagtaccgtgatccttcagagaatgatgtgttacccgctgaattagcctgtctgggtagtaaatcatgttgttgtctaacatgctagatgagcatatctcactcgaacagagagcttggcaaattttagacagaactcatttacaaaatacacatgggaaactacaatcactatgaaattaagagaagaaatagaagagaaggaggaggttgggggagggatgttctgcaggacgcagcattttaaagagactttcttagcacagaagacaaggaagctttgcactcaaaaaactgtccctccaactacccaaccaccctccatcattctctctctgacacacacaaacacacacacatacacacacacacacacacacactaaaattcacagtctctagattcacaatctctagattgtgtggtgaggtacctacctacctatttatctacctagcatagtaatacatgttaaggacaaggaagagaggagatcagaagttataaatattaaggaagtcagatcacagataagggatgtaatgaaatttctttttaatattgttcctcatttggctcccagtatatatatgtatgaatatgtgtataaatgtgtatatatatatatatatatgtgtatgtgtctataaatatatataaatataggtgtgtgcatatatatatatctcatacatgatatatgttggataacaacatctttatatatatctttatatatatcatatatatctcatatatatatgatatatatatgatatatatatatgatatatatatatgatatatatatatgatatatatatatgatatatatatatgatatatatatatatatatgatatatatatatatatatatgatatatatatatataaaaccatggataacaacacttgttttctggccctgagagtacctgggaacaaatgtgcaaaactattgggcaataaacagaaatgaattaatagcctaagaaagaaagaatttagagccagatttagaaagaggagattcatacaaactcaaaaagaagaaatctcaagtctttcagaagttcctaaagcctagctctacttgttaaatgctctatggaacagatttggggttaaaagcctaatccagcagtttatgtctgtgggccctgccctcaaggagcatatcccatgaagtatataaaacaagcatgcccagctcattagaaagaacatggtgagcaccagatggaagatggggtagaatgggaccagaaggaagggtaatttctgatgggcttcaaggaacaggtaagatttagtcaggtagctgggactagaaatgcattttaagaaaccatgataacaagtcactgggcatattcagaaaattattgtcacatttgaggctgactgtgtatggcagtgattatgggtatgtgctctggagatagcctttctgggttaaaatcctagctctaccatttactaactgtgagactctgggtaaaccatttggatttccatatgcctcattttctttctctataaaatggggaagaataatagaaacatatatagttgccatgtggattaaataatacatgtaaaatcacttagaacagtggcatccaataagtgctgaataaatattagctattttttaaaatgtggatgaagtgcaaaggaagtatccatgatttcagcctacaggggaagataggagccatatttctggagaacttcggatgccagacctgaggggtttgaacttaaatcaagatgaagcaagtttttaataatagagtatcataaaggcagatcagttggtgtcagtttgtggtaggagatatagaacaactcttgctatctgacaatacaaagggctggcttatgagataatgttctccatcaatggaagcattcaaaagaacagtctgaccaaccaaattcaagggtgttattaatggcactcaggcagcaggttagtgttggtcagcttggatggcctgcctctaagattcctttcaactgtaagttaatttaggataaagactctaggaccaatatggaagaaagattttttcaaggcactgctgggagcatggagccatagcaacaattcaagtgaaagagaacagtacagagagtggaaatggtgggaggtggggagacactgggaagatttctggtctagaatgttagaggtggaaaggatggagttctggtctagaatgtcggaggtggaaggaatggtagggctaggattttaacccacctctgagatgaaccagtcagtccagcttcctcattgtatagaaagggaaactaaaattcttggatagaagaagtgtcttataagataaatttaacaggagtgatcttagaagcagggaagccagccaggaatccagaaaccagacataaagtaataagagcttggaagagggtaggagtagcaggaattgaaaagaagcaggtggatatgagggctattgtaaaggaagcaagactgacagaatgtgggatatgggatgagtaagcaatgactccatgattttaatgctagctgagtggggaagccaaggaaagagcccattttacaaggggaagataagttccattttagacatactggggtatgaggtaaaaaagaaatattccagtgaatactatcagacagtggaaaagattaagactagagattcaggagttatgagatctcatcgttgctttcttgaggaaaagaggagagggggaaaggatggggggagggagaatagggaaagaagaaacagagaaaagagtgcggggggagggactgagtgctgagccttgaggaatatccacaggatagagataagagaggcagtcgatttacagaggagaatggagaaacagcaagagaagatgcagaaacaggagagttcagtattacaggagctatactggcagcagagtttggagaaggtcgagtctgaatggtttggaaacaatgccaatgactagcaatactaagaactgtttaaataattaaatacaatgtggctgttaaaaaatagagataaccttctgtatgcttgatagggaaagatctctaggatatgtaagtgaaaaaagcgaagtgcaaaagattgttttagtatgctaccttttgtataaaaggcaaaataaagaatctatattgacatttgcttgtgtatgtatagagaggctctgaaaagacacacagaaatatctaagcacagtgggaggtagtggtgaaactggacagatgagagacaaggatgactgggaaactattctccgccttttcatactaactaccttttaaaccacataactacattacctattcaacaaattattgaaaaacaataattgtatagagaaaacaaggatgatgaaaacagtgagaaggccagtatatttggccctcaggaagacctcattggaagccagattggagaggattcaggaagacaggcagtgaggaaacagagacactgagcatgcacgtatatgagcatatacaacatgcctacatataatgtatctttggaagggtgtctttggaagagtacacaaggaattggtaacagtgattgccactgggaagggaaattaggtggtttagggacatgaatgaagaaagatgtacccatttatatagttttaaaaattttgttccatgaacatttatcatctatccccaaaataaacatttaaataaataaattgtgctagaagagaaggaaggaggggagagggagagagggaggccacccctcacttaaaaaaaatttattgacagagagggcagtaagaagggtaggtttgtaggggccgagagggtcaagtctggttttttgtttattgcttactccccttctagtttgggaggcaacaagagcatgggaaagaacaggcactctaaaatcagataaactggattttgaataccagccctgccagttactggtccaatgaattctggaaagttacttccctcttagcctcaatttctgcatcttggaatagggacactactaagtacctcttcgtgcattatattatttcatcctcagagtctaatctgtgttttttaacaagcttcccagcaaagttgtaaactgactgatctgtgaaacccacgttttccaatgctatgaaacacagaatatagtcatcatagttaacagtggtattaaaaagacaatatgaaacacagaaaggggctttggggctgaagtaaaattttaaggtatagtaggacaagcataggatttggggtcaggtagagttgagttcaaatcacagctctaccacttactggcttggttacttggagaacattactttgcccctctgaacctcattattttcatctgtaaaataggaatactactacttaatttacagtaagtagagatgagaagattagagagtatgcatataaaattcccagaacaaaatatgcatctaattaatggtaactctgacgatcaccagcccggagttagggttcccaagcacataaaaacagcaatgccaattttctactgtgcatttccattcccttgaccctccgaaccaggcctgaaaacataaaagcacacgagctatccctttgatttttcaagcacctatgaggtcacccaaagaattccctcctgccctttgaacctttaactcattctcaaatgatttactggctgcctggcctccaaatgaccatgctagcagccatgtccttcctatctgaggctctgtccctttgataacaacagtgcctctgatggggtttaccattcccacactctatgagcctgcttctaagacaaaattttcaatcttggaaggacttaatacaaacaacagtaaggaggaagctaacattctctgcttctctcaccaatgcctgcaaaggctggatcatctcctctctaaggctttctcagtttgtttgtactcctttcatacttattgtgattgtgctaaggccctttcgaggcctgttcctaaagtcattccagtgggtgaactctccaacagtatcctggacaggaacaaactaagagaagccctatagtgtgtcttttaaactgtcacagtactactactgtgaatttcaacctgttccctttagtgcccttacataacctaattgactgccacagagacagttaaccaccaatgagattagaccccatttggaaggaagacagagtgagttccctttggcccttctcagcattctcagctttgagtaaaatagggagaatagcaatatcatggtcaaataataaggacacttaagacactgggtataaataccagacagtgactcacatccaaggccagtcagacacaacatgtcagagcttgcttaagaaaaagtgaaaacacatgcatatacattcacacatacacacacagagtgtgttcacccaaagctactgcctctcagctaaagcagtgaaacacttgagtttcactgaagacacacactacacccaccttaaacacatagcaacaagtgggatggctgttgttttaagagtctcacagcaacgcgtcccaacaccataggaaatgctgcaatcatcagccagccggcctctcccacatgcaaacctcggaacacagcttacacacaggaactccagcagcagcatgaaattcaactgttataaaccaaacttcaggcagcctggggacaagcaggtagccaaccccatcctctactgctccttctcatcctgggttgcctctgggatccttctcaacttctgtccccaacattattttcttctaagtgttccctctgcctctagttcccatgtgtgtgtcattcaaggctcaccccacttaggtggggtgtcacacaaagtttgggaaacttggccagtatatccagatcatctagtcatattctctaatttaggcttggaagtggaaaggggaaagattaccaatcacggagtaaaaaatttttgcttgactcttcttacatattatctaaaccagcaaaccatgatggagagtctactctgtgctgactatggaaaatatatagaagatacagccattgtcgtctagaagatcttgatccagcaaaccaaacacaagacagccaaagtacccaaagacagctactggaaaatcagaactccggcatttcagaggggaggttctgattgcttccaccaggagcaatcaaagatgatgccctagaggcttagaggtagggcttgaaggttaggtcctatggagagggccagagaagtgagaagtccttccaaggatgcagtgtgaagtctagccactggaaagaacatcatggtgagaaaatcggaggccagaatttcccaggtgggtttggggaacagagaggtaaccgttctgcctgaaaacctggggcctggaaggattgctaagactggagccagatggagaatggtctgtaataccaggcaaaagtagtttgggctctattctacaggcagcagggaaccattaaataattttaagggagggaggaggggatgatcaaagggaaagaaaccattgaggaggccactacagtagtgtagttgttccagaatgaggcttcttcctgcctgtcccagctcttgcaagatcctccttcaaagctgccctttcccatctgagctcactaagagctcattactatgcaactcttttgagttgagagatatatcaatgatgtttcttattctgaatgaggctcctaatgttgtactgaagttgggtcaagggcttgaaaaaaaacagaagcttcatctgaatctcccagtttagatgaaagggaagtatgatacattatttccattgctgcaacagaatcagttggcttgatccctggggtcactggtctcctctaagatgccaacgtggtagggaaaggagggaaggggagagggagaaggagggagggaaggagagagagagaaagaggagagagagagagagagagagagagagagaacacgtactgccagcatggggcaaaacctgattgtcaagtgcttttctggggcctgttccagatcactgtcacttatagacttagactaaagttcagccttaaattagggctccaagctaggggatgggagatggaagggccccacctgggtcttagcagtgggaattaactctccctgatccttaattattttggcttttattagtggctagatggggagagggatgtaacctgaaccctaatgcagctgagaagggctaagagccaaaaccctctttaagcagatacagtatgtgcaaggtctgggcaggtttcagaacactgcacttttcttcagccaaaggcatgggaaaaacacgcaaattacatcttgagccccttacctccagaaaaggagagtatcagcctcccaccagggctcacgcaacagagggaagttagcaagcaggcgcttgtaaaaatcagagcacttgggcaatcttttacacaaaaatctccccagcagctacagattcaaatcaatttcaaatataaattacaagctatttcatgttgttagagagaggagctaggtaaaggaacccatgtggtcattagccttttagcaagaagtgactttagtctacaagaaggtagggaaggagttaatttagaccaggttgcatggcataagcatctttacaacattcggattttcagttcttcaccatgtagaaaatcgggtgatgttgcacaaaagtggcaacggaaaggcattccaagaagtgattcctatcacttcaagttctaagttatacaaaatgaactttagccagtaacacctcagttgacaaagcatcccacagattggaggagatagcaagacaaagctatggccaggaaagcccattaaataacaatgcaggtctgttctactatctttggggcataagattgtctggcaattaactcgtttccacaacaaccagtagattagtaaattgtctgtgttgatcattatgttcctaaaataatgctttgttgttttaactgatcagtggctttaaataaacatgctccccaactgcctagggactttttgattggcctacagacacttcagtctcagaagatccaaaactgaactaaacctggttggtcttcccaattcccataatctctcagagccttctagattttacatattagattaatccctgactcctacctcttcttcatttcttcaatggtatgcattatcactaacttctggcaactcactaatgtatgacaagtcagcaaattgccaagatgggctgattccttcaaaatgaccttacctatctattgttcagttcaggtctttcctcatggaagcaattatgtgactggtactgtgctaggtgctttattcttgagatcagatgagatcggacaggttcagggtggtatgaccatagactaggtgccttattcttaatacactgattatccaaaccacaaaatggctacctacttccaacttgcatccattctatagcccagttttctggggtatccagaatacctggctcaaatccattcacctttatatcccactagtctgcaagaatcaagaagatctccactgactcacttatgtagccatccacacaagcaatatgacattgggcaagtcacctaatctttcttcaatttcctcatgtgtaaaatggagttaataaattagctaacatggtgaaaccccatctctactaaaaatacaaaaattagccaggtgtggtggcacacgcctgtagtcccagctactcgggaggctgaggtaggagaatcgcttgaacccgggaggcggaggttgcagtgagccgagatcacgccactgcactccagcctggcaacagagagagactccgtctcaaaaaataaaataaaagagctaatatgtgttaagttagaaaactagtgcccagaatatgcactataaagtatttgttagaaaacaaataaaagtgacatctatggagctctgtgctggtttcattggccataggaagaatagctcagctcctagaacaggcactcaataaaatttaatgaatgaattaataagtggataaatgaacaaacactacatgctctgcccttatgctgttagtcaacacactgtggagtgaacaaactggtctcagtcttctgtctgtgtctttaggacatgcagtgcttgtagtaactggaatcaacgtccttcttcctcccaggcctacctacctaaatcctgtattatccctcaaggcctagctccaattcttccttttttcacaaaacacccagctacatcagcccacaatgaaatctcttcccactgaataaatgttgctcttagatcctaccccacagtttcagtacttaaagctttttgtttcctgggcttatagtaatgcagctcttcaacaaaactgtcatctcttttgagaatccagaaaccaggtcttctatggtggctaactcttgtattctctagtttagggttaggcactttacaaagtgctcaacaaatctgtgttgactggttggttggttagttgatcagttgattgattgattgattgattgattggaggcctaactgagagctcttaagatgttagcctttcaaagtgctggctgttcagacattagcagaaatcatggctggtcttccaactttttgcagtagcagacattacacgaaagctgccctgccatttcacataattcccaatgattaggtaacttcatacacttcaatttttaggctcaaaattttcttaagagaattcctgtttaataagggacacctgtggaatgcgcttgcttgctttcttacatcacatatactgctaataataatatgaaataaatgataaaatgaatctctctccctactggacaacagcgcaggttgtattactctcattttgcaaatagggcaattgagatagagagatgaaaatgacttcccagggtcacacaaatgaagagtggcagagttgggactaaactttaggctttctgaataccgacccagtccccttaccttgatttgagatttaaaacaaaacaaagaccttcctttgaccctgacctctgaggaatagatactcataatattatcagtttctgcatcaaatttcatttccctcatttccctccctccgtctgtcccccaacctctcattcttatctagttctcttctatttctctgtctttcacctgtgtaaacacactattttagaaagagcatgggatttgaagttggacagaagtaaatttgaatgtcagttgtcccacttactatatgacttagagtctttcacttaacttctcctgagtctcggttcttcatctgcacaatggagacattaatatctggcctcaaagagttactgtaaaagttaaatgaaaatacatgtaaaacacctagaaaatagcagtatttgctatacagcggtccactacctctccgatcccaccatgtctaggctttgaccacctttgggttcaagaggttactgaactcaatgaggcacagccacacaactgaagtatccaaatccttgcctggtctacttttgcttgttgtcttgatccttcctgatcgccaatttaagttaatacagagctccaaactcttgtcaaatcctctacagaatgtgagagtcaagcctgatacttaccccctgaagcttcaagatgtcatcactcacactctcagtcagagtaagatgccatccaaagctgcctacctgtagaatttttcagggtggcttttacttatatcaaacacaaacaaaaagaaatggaaaacagcaaggcagcccaacaaagacaaggctttagcttgtcatcctctcataagtaaagatggggctacagccataagactctaactcctttccagaataactagtcaaaccagctttacttctagctctacctcatctcacctccaaccccctccccgaaacgaaaaatcagtttcttatggaccgtgaaaggcagtataggagaaccattgaaaacttccctgccagaggctcaggaaaaaagagagaagatcatacagctaggaaactgttgagtggcattagggtgggggacagaagacaccacaaaggggctgttcgtaactgggcttaacccttgatcctgtcaaattagtcccacctcccgcattcctcacagatgtaacattaaaagagttgagtgaaagttaacagaccatgtcctccctgagaacataccaggaaacagccacttctagaaagataggaagtaggagtgtggagaaaagcaatgcactccaagagctgcctgctgtcagtcagccttcacacttccacagcctagaccaagtaagggtccttagcaacccttcagtaaagcaagaacttgtcccatggagggtatgagaagaaacaggagggtgtggagagccaaagtagcatgccatgattattcagcaagttgataaaagaatataagaacagagattctgtccatcactgaaacaggatagagagagatgcagtgtgaggaaatttccctctgattctgttatgatttgctgattgttttcaaacctatcaacctcaactctgtgagcttctctctccctcctccctacccaccacccctccccgccaccactggaagcatggctgagccaagagggacaaagctggtacagcagactagaagggctcactgtgaccaaaaaagaaaaaaaagttgggttttggacagagggcagggcagtcaatgaatgaacaaaggggcaatggcacttgaatgagacggtccaaaatgtaggcctcaagcaactggtgctcttgggtgggggatgggaactaaagacttgacatgaaagaaggacagcctagatgcatggaaaatgtgtctctgttgctactaggcagtacttgtgttgcgatatggtacagtcatagattcacagtgaaagaggaggatgtggatgtgaagtcaaaggggagaggttagagctcactttgaaagatcaagtcatcttgacttttgcaacttcagtgcgtggccaggatggctatctgaccaagcaaacatgccagtgtgatgtgaggaagaatggatcatccgttgcaacactaatgcgtaagacaatttttccacttggcctatttacactggatagggcaaagaggtataaggagacaaacctctaccccttcccagtccttggaacccaatctttagccataaaaaatagtaactcaacttattcattaatgattttattgaattatgtgtgaagggagtatatctcagggagcaccaggagacaaaattttggctccatggaagctgagtgaaagtgatcttgataccgacataaccaatataaaaacgttacttgctgattacaagataactctcagggaaacctggaattccgtttcagagggaaatgtaaccatgcacacacatctggtcccagcatcaaaggtatgaacaccttgggcactaatggtagcagaatcccaaactcccccagaactgtgtaacagagctatctagagcactttttgttcctaacttatgaatgcattgtttcccaagaatatcttctataaataagcagcttggagctttgaattctgtttcctgtagataggacattataaatgatggttaggttgtgtaatttaatcaatgatacactatggattaaataggcttctccagaactgttctgaatgtaaccattataaataacattgtgtcagtgaagacacgtttcctagacctctacactctcttcctcagaccccttacccttcagtaataatatagattaagccccactccaatccactccctgatcgaggctttagtagtaacgaaagatatttttccagctcagatgacaactggtaaatgtggggagatggggagaaagaggctgtggatgcaagacctccagcaggagtcactcttgtgtgtattccaggtacagacagaagaacccagagctgaaggatggcagcaacagcaggggcttttccaatcagtgtcagtggaggtatgcagggaaatatatatctgacagtggatagggacagagactgctgtctctatattcctacataggggctctgtaaattgaagagtgtatggcacatatggttagcatcttcaatcttggagacaactattctttccagaaggggaaaaaattaagttcagagaggtaaaaaggaaataaaaaagatctggaattctgactttgacactattcattaaatgccatttccttcttctattatacaaattccttctctgtaacttaataatctctttgtttaaacatacatgttccttgaagtcagggcttatatcttctctctcatctcccctacgatgcatttaccaaggctggccagggctaggggcagaggcaattctaaataaatagtaggagatgaaatgtgtccctcccaaatctattatgtggctgtcccagatgccttcatagaggccttaggcaggtatggcttaatagcagcacagctacttccattaaaagattttgacacagggccttggtatgacatggccgccagaaagagccaaagtgatcttcagctgtatttttttaaagaatgttcatactcaactgtggtcagattctcctcagttacagtattcagctgtgggatccataacttaagaggaacatggacaagctgaagtgcatcatgagtgggaggaggaaacaggaggagaggctggaatctacatcccataaggaacagctgaaagagctagggctctgctagaaaagtgaaacaagatgatataatatttgccttcagatatcccaagggctgtcccaagacagaggaagcacccttgttctgtgtgatgctatccagaggatacagctaggacccatggatgatcgctaaaaggaaaacgattgcagcttaacaaaggaaaagctgtccacagtcaaaactttccagcaacagaatggataggcttagaagggaatgagctcccctgtgactactgtagaacaagctcagggacactgcacaggaggctcatgaaatggttaagattagactaggtgacttctaaaaggctctctttactctgagattctttgattctaggtctctaccaagaacagaattactctgggagcactgagttaagtctgccccttggtgcttgaggggtagaggggcaggcagtgagagcagcccttcccataatccctgctgttcttcattaacttttctcagatgggtcagcatcttttttcccttagttctaaagaagtctaactataaaagccatgatgttccctccagataatcatccataacctccaatctcaagtctgagtctctcttttttctttaaagaaattcctggggagggggttggggaaggcaaggggggaaatcattttaatttttttaagggacaatggagttgaattattttctttgtgtgaagttttggagagggaaaatcctctaataggcttgaccttttttaacttcagcaagcatacatgtggctctcaatggggtaccaggtgtattatgaaaacccagcagggccaaaagtagtatcgactcaaagctcagccaagggttaccagccataccacccacccttcttgctccacctccctccaaccttctttgtatctctctgatggatttctaatccatgcctcaaaatgccctctactttctgggatagggcagcaggtgggaaactgaggtagtggacatctttggtgattctagaggcagaaatgaggaggggattcatgtaggtaaccaggctggactaagctccaaagatgcacaccccacgaaggtccctttgtgagtgccaggcactggtctgtaacacagctcaaaagatttcacaggaactctcattgttcacataataccacctctgcacccaataagaattcaaaatcacagccaaatttacttccagccacaagacaacctctatctgagtttatccagatcctcttgaagtctcaactgcctctctgtgtgcttctagaaataaggtcagactaggaatggaatacagactaaaacaacttgatgagcatgccctgccactgtcctaggctaaggatggcaaacactattagagtttgcctaattcattgtctcatcatctgtgataatagagatggggcagttatgcctaggccccactctgcaaatagagacttgggtctggagagtgtaaaattatatagcaatatcagagcacatcaagtggatgggagtaaagcttctttctcctccaggttactcccctaccccactctgttttgttccagggcagtaactagccccacttgcttcactatgccagatagaaacatctaccataaacgagccaagaaaagggaaaatatgttagcatgagcctacatatcatcagacacatctgattagaagagaatccccattccatccagacagtacttctgagtcaatgaggtagcgtaacatgttaaccaaaggaatcaataatgccaatgtcatgggccctattcctttatgggtcatgtatcttttacttgttaccatgatctcactcgaaacaccacaatatagggaaacatcataaactatcccttattatttaggataatcaatcgtattttattttttggaggtggggtcacactatgttgcccaatcatggtacactgcagcctggaattcctgggctctagggattcctcttacctaagcctcctgagtagctgggactacaggtgcaagacaccgcatccagcaatagtattaaaaaattttctctttctttgccacttgactgtcggggggtactatacaagtgtccataaatcaggcagttgaattccccatattcagggaaatcataggaaccagcaggaattgatgatttccccaacttgatcatttcctggtccaaagggtctcccatgacaactatgaactagactttcacactgcataccctcttcccccactaatcactactttttcaaattcccccactccccagatatctccacttgtgccacaagatatctctgagcatgtatgccacaccatccctgatgcaaaccgcttctggttttttttccacaaaggaggttctctgccattttccaccatgcttcctgcaccttacctctgtctctccctgacctgagatcatcacaagtgatttggggtcatcaaaatagtcctttcctactctgagcccagactccatcagagtgtacctacaacccagtccgtcaccaagtatggaattacaggctggcatggaaagggacactgcattaggaggctaataagactagatacatccctgaaagttattgccctgtgctccttcacaaaccacagtactaacagaagaatcagaaactctcttagtaggactgccattgactctcagtatgatagacataggtaagccactgaatacatcagtctcgggttttccatcagtttctccacaatctttcctgactgcctcacagtgtagctgcaagagagtaatgaaataaaggatgaggaagcacattgtaaatagtaacactgtatgcaaatgaagcaaagcttcattttcctcactctgcagcaacacttctgagaagagagccagagctagcataaaagattagctatttggccaggagtggtggctcacgcctgtaatcccagcactttgggaggctgaggcaggcagattgtttgaaggagttggagaccagtttgggcaacatggtgaaatacaaaaatacaaaaatacaaaaaatcagccaagcatggtagcgtgtgcctgtagtcccagctacttgggaggctgaggtgggagggttgcttgagcctgggaggcacaggatgcagtgagccgagctggcaccactgtactccagcctgagcaacagagtgagaccctgtctcaaaaacaaacaaacaaaaacatggctactagattgtcatagtatcatttaaagaccacccacttgaatgtcattttagatatggggatgcctagacccaggtagggcaagtgatatacctaggattccagaactagagagtggcagaaaaaggattagaacccaagtttttaatctgccaacccaattatctttctattaccttccacccatcccaaccagtgtgtacagactaagaaggctgttttcaaggagaaagctgtattgttctgaatcataaaaggaaataaaatcaaggttgaaaaatgaagagggaattaatgaaatatgccaaaacagtgtcttgtcaagaaaaacacaatacaggcaatcattgtgcttaaaaaaatactatggtccctttatataccgttgaagccaacccagttataactgacttttactgttaagaactaggctatttgggaggaatgggagaaataattttatcccttgcatatctaaatgcatgtcataatgagccttcatataataggggtcaactgtacattcagtggaaagggaatcattaaaaggcaccctgcctctcaacacacgaagcacttcctctacagcttggccaaggaaaccctcatctaccctctcaaataatcccccagccagaccacaaattgctggctgccccatacttagtaacaccccctgccatgctctcactggctcacaaaataatccgggaccacagcagcaagcactctctggggtgcttctcaagatgggtcagctctgggcagagctgaaaaatgacctctccaaggcaggttgtctaggcagactgtggaaattctgtgggcggtgtgaggagaaaaagaaagggaggaactgccagatcatggagggctgcatatcccattgtgaccttggtggaaagagtggggagaggaggagcttgattagaagaaattcctgaaggccaggattcccctcaccaaaggagttgagtgtttttgttaaaaaaaaaaaaaaaaaaaaaaagcatataactttctccagagaacactggagggagactgcctcaggaggggttgtgacagtggatgacaaacgcatctcaggctggttaaagtacatgacaagtatgggggaaagggtgctggatgaagatctgggctagtttggggaggctaatgatcagaggggtccctgccagcccctcaaaatgttgcctcagcatacctcagactcctcaatctgattggtacacccatggcaacactccagggttgctaagagtgtgggccccaaggcctgaaggatcccatacactggaagtcaaccacaggctccaatgcaaggcgaatgccgcacaggttattgtgggtgtgtgttgcggtggacgtttgctgaaccctctgctgagatgtgaccaatgttgaaccccacccccccgcaaaaaaaaagtgatatttgctccctgctgaaaagacacatctttctatctccagcctgaacccacatctacaacttcaactgccatttaagcgggttggaagcgggagggcttttcggatttgaggatttaagagaaacaacaaaaaagtggaataaagttcgtaaagtccgttcacttggcaatctggcacctcaaggtgagtcgtcccacaagtcactcttcctggtaacagctccagctgcccctacccctcgccctcacccctacgggggaggctcgctttgggggttctggagcactcaggagagctcctctctcctgtcctcagctgcaacttggcttccagcagatcacagactcctaaaacaaacaaaccctggcggcggcggcggcggcggcagtggcggcggcggcggcggcggcggcggcagcggcagcagcaacagcagtagctccagcacagctgcgctccatggcgcaagtttcctccacacttctcaacgtgcaggaaatctcgccggcgctggggcaggactctggagggagggagaggccgagccgaaccggcggcaacaacgccccaagagctgaatggatgtgtgcgcgtccggccgtgggaagtgtggctggcaaaagccaccaatggcctcatctccgttcccacaccagcccctagccctgcaacctgcctgggagggacggcccgccggtcgatagaggggacaacgctgccaagagagctgccaagccgcgatgactgtcccttcagtccttcactgtcccgcagggacgcagaggcctccaaggagaaatccccaacagcctccacttccttcggcccaaactgagggaagtagccgccccgacgtggggcagcaagggctgccccagcgccctcgcgagtgtgtctgcgcgcaaggttctagccgggggccagttgtgctcccagctcgtgttccagccacccttaggggatgtctgcacctggactggtggcaagacccctccgtgccgctcagagggtctttcgctcccagccctaagtttcaaagttggcctgagggccccgtccagcggcagccttcgcacccgcttgtccattcaaagttaggcgccgttaggacatcagccgccagttcttaccttagacactgtgagcggctcacagtgttccagaccccccttaagggtgaagccccagggtgcccccccttgcagctgcacagggacgtactggaaggacccaggccggttctccatcctcggctgggctcaggcgccgccgg

SEQ ID NO: 2259 - DNA, 222401 bp, Homo sapiens; identical to SEQ ID NO: 2258

SEQ ID NO: 2260 - DNA, 99297 bp, Homo sapiens
cgccaaacaaaagaggacagcacttccggtcacgccatcgttgctgccttcttcgtcaaggtgagtgtaaagaaggggacttggtaattctcacaaataaatccccatacactccagggaaacctccttttgtgcctcaacgtggggtggaaaggagaattcatccccgcgtgcgttgtatgaaggatgcttctgacgcctgtggttctgatcgcctcgctatctcctcccttctcctccggagatggggggcccgctcctgcctcacctcctcactctggtggtccctttaaccgcttgactcctggtcatgcttcacctctcctctttatcccgtatcctcttctctggtctgagccagcgtcattccctctaccacaggtcactcctacctcctacctctcacctccgccttctgccccccatcctgttaacctgcgactctttgcgagccccttcctaccctctgttttactccccctgctggcctttggtctttcctgttcccctcccgcggagaccagtaaattacgtactttgcaacagtaggtgtgacttcaaggtcaaggcttttttttttttttttttttggttcttttaaagtataagcaaagaagcagaaaccttagagccctaagaggcataggcacttgtccaaatgatgttcttttttttttttttttttaactctaaacaaaattacacatcatttagatactattgcacaggtttcagtcttctacacattgcatttatttttttatgttgccatagaattgaatcctcagattttggggggcaaacatagtggattatacctgtaacctggtttcagcttcagcgtaagctttcccatcccctgtaaaacttctcttagcagtgaaatggttgacaggaatggcatccagtcacaaatttattactttatatgagttgagtttattatgcaatttcttttctggtctctgatagcaacattaaacagcaagctgacattttgcagacgaagactttttctgagagctttgcaagtattacacaatctatttgttgcaatgtgaaatgtacttttctattacatttgttaccatgtcaaatttatcttgtgagaacattagttattaaataataatcacagtaccgaaatgatcattaaatttatgctgagaatcagagttttccaggctctatcaggatctaacgaggaatttaaccaaagttctctttgaataagcagtggactccttcctgtgtgttatgcttgccagactaaggggtgattatcttttctaggccatgtatagtttttatttaagaataaacaatgaggcagagcttttgtgacaccaaaacacttaggaaagagtattgctgatgtctctttatactctattcaaatcattattacacagcatttaaatatcacacttgtttcaacccactgtgcatccatccattcattcaataattttttattgaataatttttatttgccagacagtgttctcagcactggagatacaacagtggataacaaaaacaaagtcttttaaactatagctgggagacagacaataacttaatatataaacaatatatattggcaagtggcactggtgttaaatgaacgaaacaaaaaaatacatgaagaaataaaaaagaaaaaaacaaaaaaagaaataaatatgtaataggttgtaatgtggacgggttctactattttagataggatgggcaggaaggcttcactggtaaggtgatatttgagcaggaacctgaaggaactgagggcacacactatgcagatattaatgggaaaacaggatttatgtcatagtctttgcatttgttcactctgtttcctaacccgcggccaccttcccattcccctagtggtcacttttctgcatagcattaattcaacgctctgcatactcaaataacctgatccattcacattaatttctcatattctcttcctcctggctagcttcttgctaccatttaggcgacttgtcagcctctttaggaagacatatcactatctccatattcacctcatcctcagtttgttgattgctggtgcattgtgtgctatcctacaggatatttgattatctctctcgctgctcttaccactttgtgttcataatatgttgtccataaatatttggtacggtaaagtgaaatgaattcagtgcttgtttataaaagataaaacttttaaatatggctttccccctaatgttcaacactattctctaaggtcagtattatcattgtcattttactaatgctaaaaccaagactaggaggtatgtagtaacttgctaaactgtggtacagtttatggagttaaggtttttcaggcactcagtcctggtctggttctctctatctgtttcttaatgagaaataaaaaatatacagaatattttattattttataagacaatccgggtatagaaattttattttttgtgcttctttcacaacttagatcatatcaggtgcttgaattactccctaattataaatattaagctctgagaggcatgaataatgcctctttttaccagaatatttttaaataaaaaattaaacaagcagaagttgaaagaagagtacaatgaaaacttttatattctggacctagattcaacaactgttaacctttgccatattagctcactctctctattactcactctctttctccatgcatccatccatccatccatccgtccatccgtccatccatccatttatccatccatctatctatttttttatctattttggctgaaccatttgacacttgcaggcattattttaagtaaatgtaaatacatgcagaaaagtgcacattgtcctaagtgtacagctcaaagcattttcttttcttttcttttttttttttttttttttttttttttgatggagtcttgctctgtcccccaggctggagtgcagtggtgaaatcttggctcactgcaacctccacctcctgggttccaacgactctcctgcctcaggctcccgagtagctgggattacaggcacatgccaccatgcctggctaacttttttacttttagtagagacggggtttcaccatgttggccaagctggtctcgaactcctgacctcgtgatccacccgcctgggcctcccaaagtgctgggattacaggcgtgagccaccgcgcccggccagctcaaagcattctcacaaagtgaactcggctgtgtaaccagcatcaagatcgggaaattttgaaagcccctaaatgtatcccttatttgttactattccaaattaatcacaatcctgtcctctgtcattgtataataataattttgtctgtttttaaactttaaaaagtaacacagtttgtgttaattttttggcttgaggatttgtttttgagattcatccatattattgagtgtagtagtaattcctctattttcattgctattccattgtatgaatgtaccacaatgtagttatccttttattgtagatgacatttttgttgttttcattttcagcttgcaaatagtattgtgagcattctagtacatgtcttttggtgatatattcacacatttctgttggacatatacctaagagtagaattgctgaatcacaggttatgtataagattaattttagtaaatactgccagccagctttccaaggtgattgtacgagaagactcctaacataatttttttttttttttgagacaaagtcttgctctgtcgcccaggttggagtgcagtggcgtgatctcagctcactgcaaccttcgcctcccgggttcaagtgattcttctgcctcagcctcccgagtagctgggattacaggtgaccaccactacgcccagctaattttttgtatttttagtagagatggggtttcaccatgttggccaggctggtctcgaactcctgacctcgtgattctccagcctccacctcccaaagtgctgggattacaggcctgagccactgcacctggccagaaatttttcagagtggaagttgctctagaatatagccaacacttgcctttgtcttggtagctattctaatggttatgaatggtatctcactgtggttttatttcgcatttctctgatgatggacctttccataagtttgttagtcttttggatattttttatgaggtgcctgttcaaatcttttgactactttttctcctgggctaacttttttttattgatttataggagctctttctatattaaggatgtgaatgctttgtcagatatatgtattacaaatctcagtggcttgtatcttcagtctcttcatggtgtcttttgatgaactgaatatctgaattctaatatcattccgttcattattttttttcatttatggttagtgcttctttgtactgattaggaaacttttatatttcccaaggccatgaagatagtttcctaggctgtgttattgtttaacctttcatatttatgtttataatctgtaattgatttttgtgtatattgtcagtatgggtatatgtaaaggccctttttttgttgttgaagtgacattcagtcaaccccaaaccacttattgaaaagatcattctttcccttttgtagtgccatccttttcattaactcaaatatataaatcaataatttgatatagttctgaattctgttcagtttggtttgtctatccttgtatgaataccactgtcttaattaatgtaacttcacaacatgccttatgtatggttatgtgagtcttacacttttgttctttttcttcaataatgccttggttattcctggtctttttccttatacgttttagagctagtcaatttctacaaacattcttcttggcattctgattgagataccatctaacagatcagtttagggagcagatatcatggcacgtcacccttaaatatctcagcattcatctcctaatattagcattactttgtagtaattaattaccattatctcactaaggaaaattaatgattccctaatatcaacaaatacctaatcttttcaaatttattttcctcaataagcctttgtaagctggtatttaaaactatcatccaacctagattaatgtattgttaagtttttggggattttattggtgttattttctctcctttgttgaacttgtgaatatttatatatttagtacttttcaatccattgcagtcattatttcttctgttgttccaactgtccaatcatgtcaagtgggagcccattcacattcacattggcttctgtgtcttttctcttttgttacatacattttcaaatatattcaaagtagaaaatagtaaaataggctgtgcatggtgactcacccctgtaatcccagcactttgggaggccgaggtgggaggacaacttgagcccaggagttttagaccagcctgggcaacaaagtgagaccccatctccacaaaaaatttaaaaattagctggacatggtggcatgtgcttgtagtcccagctacttgggaggctgaggggggaggatcgcttgagctggggagtttgaggctgaagacagctgtgattgcaccagtgcactccagcctgggcgacagagtgagaccctgccttagaaaaaaaaatagtaaaataaacatgaatgtatccattccccagcttcaataattaacaacattttgccaaaactggcaagttttgttttatctattctcacccatttttttccacatcccagatatgtcattacacaggtgaataactcagtatgtatctctaattcataggtgcattaagtaaccaccacgtcattattatacttagtaagataaataataatttctttcttttttctcttttttgagacggagtcttgctctgtgcctggtgaattgtcttaaagttatagttatacagtagctttgttaagtcagtatccaaacaaggaccatttattgccaatggatgtttttctcttaagccttataaagcccttgcatagtcccctttttattttattttattttattttttttttgagacggagtctcgctctgtcgcccaggctagagtgcagtggcgcgatctctgctcactgcaatctccgcctgccgggttcacgccattcttctgcctcaggctcccgagtagctgggactacaggcccctgccaccatgcctggctaattttttgtatttttagtagagacggggtttcactgtgttagccaggatggtctcgacctcctgactttgtgatccacccgcctctgcctcccagagtgctgggattaattacaggcgtgagccaccgcgcccggccccttagtctcctttttgaaagatcgttgattaattcaagaaactacgtcattagttctatagactgtctcatctggatttagatgattgcttccttgaggtggcatttattttgttttctcatcctcgtgtttcctatttactgacatttagagctagaggcttgattagattcaattttgattattttttaagagaaagactcattttaggcagtgctgtttactttctattgtattttatcatgtctaattttatcttttttttaattgatgctgggattgatttgtcatttcagggtgtttgtcgggctgatctctccattgtagcttttcccaccaacctttcttctgttggttttagcagccattgatgataattgcctagattcattatttctgtagaggttgaaaaatggtgatatttaattctttcaatctttctgcattattaactggaattactttataaagaagactttttccttatcagctattttttgtcctgaagtatatttcataataatcaagataaatgatgctgccgctgctgctttttttcatttatcagtgttcatagtaatgagttggtttcttagcaaccgccactgttttctttaatatcattaagaattcatggatttttatgtattttaagtgtatcaacccattgtggtcattttttaatgcttaaacagtgtcatcttataaattaggagccccttctgttttcacttctatgttttttttcacattatctcgttagtctttgttggcgtccttgctttttggcataagctattttaggctcatcatgtacactccctgccccacccctggaattagccattttacaaggaactatgtaatttttcagtgaaccttggtatttagaaactaagatgggaatactcaggggattattattttaaaagtcatgctacctgatctttagttgtgctcttttccctgctattgtgaatacattggaatgactcttgcagcattttattgaaaattcgctaaacatggctttcatttgtttatgtagtcattcattcagccaaaatttatagaatgcttactatcatgtatctggtcttatgctgggcacagggaatgtgagggtaaacctgactggtctcctgtccttggagaagactcattctagtgtggatatgagcaaatacgcagtgtctaaagagcagtgaacagtactgtgttcatactctttagacactgagcatactctgggcataggcaaatgggctataggagcacagagaggacatcccaaaatgctttggaaagggaagataatgcttgatactggtgagtaaatgaggtatgaaggtagaagagtaatgaagagtgttccattcagcaaactggaagaagtaggggggaatcttgatatagtcaaggaaaggcatatatgtagttggttatgatgggaacataattgtgtaagtttttcagttttcagaagattgacaaaatagtctatttaccacagacatgaagatgtaaaatgttgtatgtatgtgttgttgatttttattttaaatctgataatgaaataatccaaattctaattaaaattagtatttaatgtacttcttggacctgatcatattttttagttatttcattaatgttaaagcatagttacagttaggagatgtctatttcgtgttttagttcactgcttctttattttttactattattttgctttatacgtgttaagaatctgaattttcaagatatgacattaaaaatagtggcatatttattgtggctcttcatctcccttcattctttggctgctatttgtgtcaacccgtttaataccataattacagccccttacatactcacaaggcaaagttgttccagaaaacatgtcatctctctttattaccaattggacattatactatacctgttacattttacagcatgttgcacctgaggctatccatctgacagatactgcatgaatagtatgttaaacacaggtttgtggtttaccggagtgctatggtttaccagttgggaattttgggaccgtgagtgtgggagaatcactaggcttaggaaggaaccacatctcatatgtggccaggaggtgaaggggtgttctagaaatcattgaagaatgtggggaagcttattttttaagggggattctagaggtcacaaagaaaagattccaggtgggaaggagagcagtgaaacagtagattaaaggggaagtgggagtagattactacttttcattctctctatttgtcttctttattataagaataatatgttcccagagtcctgaaaggcaagaagtatgagtgaacaagcggggagtcagagaaggtgagaaaggaaaacatacactgtctgagaacgtcagatgtgatgggagagcagtggggggaagatagattgcaagccttaggatggattgataagtcttagaaaagacagatcattaattaattaatcagtcaattaactaaaaacatactgatgactagctggataatgagaacatgtaattgacttaaacatgttttcaactgagtgaggtagacatagacattgcaacagcggtgctatgctagaggagagaccaaggtgtggtgctggcagtagagacatagaggaaggacctctaacctaccttaagggctcagagaaggcttcctagaagagaccatattaagtgcacatgtaccctaaaacttaaagtataataataaaaataaataaataaataaataaataaaaaactgaattttgacaaaaaaaagctgtgagtgggaccagagagcaagtggtcattggtcatttagacgatgtaaagtagctgactggatatgccatttagccttgagcttgaaagtacctaaaataatgggcaatttagaggttactctgtggtctagtaaagctaaggaaaaggggcaaatggaaaggaatagttttataaatggtgtccccattctcccagcccatggcaaccactaatatactctctgtctctctgaatttccctattctgaacatttcatataactagagtcttgaaatatgtggccttctgtgtctcacttcttccagttagcatagtgttttcaaagtttatccatattatagcatgtcttagtatttccattccttttcatggctgaaagatattccattgtatgagtataccaccttttatgtattcattcatcagattgtagatggacagatgagttgtttctactttttggctattatgaataatgctgctgtgaacttctggtatacgtttttgtgcaaacatatgttcttctcatttctctggggtatatgcctaggagtgaaattgatagtaactctatacttaactctttgaagaactgccaaactcttttccaaaatggctctaccacttaaattcccaccaggaatgtataaggttccaatttctccacatccttgctaacacttgttgttttcctttttttttttttttaaattacaaccatcttagtgagtatatataataaagaatctcacttaatttttaaaatataatatttaaccgctgacatctttttttttttttttttttgaggcagactttcactcttgttgcccaggctggagtgcaatggtgccatctcagctcaccacagcctccacctcccgggtttaaccgattctcctgccttagcctcctgagtagctgggattacaggcatgtgccaccatgcctggctaattttgtatttttaatagagacggggtttctccatgttggtcaggctggtctcgaacttccgacctcaggtgacccacccgcctctgcctcccaaagtgctgggattacaggtgtgagccaccatgttctgctaactgctgacatcttttaagcctcacctctccctcttcattttctgctccacaactgggcaagttaattagaaagcatgagtgcttcatcctttggagctagcaagagattcaaaccatgcaagtgtcttcctgaatgtaagaaccctcactcctgcctcatcctttaaccacagtaaaaactcaatttagtttcctttccttgctttttctaacctgcttaggagacttgccttgctgtccccagaaatgcattgtttatgtaagtaagtagtaaacattttcataccctctttgtgtgtgaggtgttatcaatctgaacactggaatcaaaatttgggtggggtccctccttcttctgcaggatggcaagaacaattggcacagtgagcttggtgctcagataatgacagccatcatggggggaagggagtatctttccttaattgctttggctcactaattggttctgatggcaagcataaacattgagcctgcaagggtagctagttttttagttgtactgtgctgtgttgtattgttgactcctgtagaacctctcttacagatttagctaacttggaagtttaggtaatttaatggacattgaggaacagtagtatgggatccttaaagtagccctggatcatgtgtctcagcccagacctatttgtgtgtcttaacgtaaagctgtgactgatgctaggctcaggaggaaaaccatgtctatgactagctggttttgtgtctcaattaggctctgaccctgacagctgactgcccattgggtggtcgctcttgagagcagtcatcagggagtgaaaaaaagagagagaaaagagaaaagaaacagctattatgtggcttgctggggtctggacttcgaagcacaaatgactcactagaacccttaaatacctccgttgttatggctgttgctgctgctgctgccgctgccgctgctgctaccgccgccgccgctgccgctgccactgccgccaccaccacctgtgcttctgttgcaacaaagatcctgatcttcaggattatagggaaaaacattagtggcacccctgtagcatggagaaaggggtaattcaaacccataaagctcctagtcctttaatcttatatgaccaccattgcctttggggaggccccttacagtgacagtgctgatttgagactttctgcaggaagacatttataaatatgagcaggttagggaccccgcagaaatatatccagtaacaacagcaacaaaaaaacaagtacagtcatgtacagcattatgatgttttggtcaatgacagatcacatatgaggacggtggtctcataagactataatggagccgaaaaattcctgtcatctagtgatgtcatagctgttgtaacattgtagtgcaatgcgttactcacgtatttatggtgatgttggtgtaaagaagcctgtagtaccagtcatataaaactagaacaagtaccattatatatggtacataatacttgataatgataaaaaaacagctaggtgtggtggctcacgcctgtaatcccagcactttgggaggccgaggcaggcagatcacttgaagtcaggagtttgagaccagtctggccaacagggtgaaaacctctctcttaaaaaaaaaaaaaaaaaaaaaaagaaattagctgggcgtggtgacgcacgcctgtggtcccaggtactctggaggctgaggcatgagaatcgcttgaacctggggggcagagcttgcagtgacccaagattgtgccactgcactccagcctgggtgacagagtgagaccctgtctcaaaaaaaaaagatgaaaaacaaccatgtttatgtatttactataccataatttttatcagtattttaaaatgtagtctttctacctattaaaaaaaaagttaactataaaagagccacagacaggtccttcaggaggtattccaggagaaggcattgttataggagatgacagctccatgtgtgttattgcccctgaagaacttccggtgggacaagatgtggaggtggaagacagtgatattggtgatcctgactgtgtagggttaggctaatttgtgtgtatcttagtttttaagaaaaaagtttaagaaataaaaaattttaaacaaataagcttatagaataataatataaagaaagtatttctgtatagctgtataatttttttttttttttaagatggagttttgcttttgttgcccaggttggagtgcaacggtgcaatctcggctcactgtaacctccgcctcccgggttcaagcgattctcctgcctcagcctccggagttctgggattttaggcgtgtgccaccatgcccggctaattttgtatttttagtagagacggggtttctccatgttggtcaggctggtgtcgaattcctgacctcaggtgatccgcgcatctcggcttcccaaagtgctgggattacagatgtgagccactgtgcccggccatgtgtttgtgttttaaaagctaaacatcattacaaaagagtcaaaaagctttacaaaattttaaaaagtttataagtaaaaagttatagaaagctaagcttaatttattattgaaagaaatgtttaaaaaatgattttagtgtagcctaagtgtactaaagtgcacattagtgtacagtaatgtcctaggccttcacattcactcaccactcattcactgacccacccagaacaacttccagtcctgcaagctttattcatggtaagtgcccagtacaagtgtaccatattttgtctttttttttttttgagatggagtttgactcttgtagcccaggctggaatgcaatggtgcgatctctgctcactgtaacctcctcctcccaggttcaagtgatttctcctgcctcgccctcccgagtagctgggattacagatgcctgctaccatgcccggctaatttttgtatttttaatagagatggggtttcaccatgttggccaggctggtctcgaactcttggcctcaagtgatctgcctgcctgtgcctcccaaagtgctgggattacaagcgtgagccaccgcgcctggccatatttttgtcttttataccatatttttactgtaccttttctatgtttaggtaggtttagatacacagatacaaaaatacacagatacacaaattgtgttaaaattgcctacagtattcagtacagtaacctgctgtactggtgtgtagtctaggagcaatagtccataccatataacacaggtgtgtagtagtgtataccatctaggtttgtgtaagtacactctgtgatattcgcacaacagtgatgaaatcacctaatgacacatggcatttctcagaatgtatctccattgctaagtgacacgattgtaaaagaaagaaaaaaaaaaaacagatatgagaggcagaggaaacaaacagaaacggagatccacaatttgacccaattagaatccagaatttatggaaaaattttactaaaagagcaaaaagataaaagggtgctgattggtgttgaaatgcagtgggtggcaaaacttcatgaccttaattactactggggctcaaattggttattatgtcaggatcccactatatttaatcaaggtgcctcctgtaatctaaggggagttcctgaacaggaaagagataaacaagtatacctcacattaactatcagaactattgccttgcctgaattcctcacatttgtaccattcattgccttaaaatatcccatagtgggtatgagcactctgatccaatgagtgataaaattaagtatttggcacatgtgaatccgtttgacaatgtgagatcccaaggactatacccccagttaaaataggttaatacagcccactgtaaattagaataagtctacaaatatggaaacccatgatacaaggcctatttggtgaaagggtgattatccccatgtcttctccattaacaacccaatttggcttgttcttaaacttcaaatgaatggcacctaatggtggattaccataacgctaatgttgtggtcccacacattaaggtccccatacccaatattgttgacattactgactccatccggtctgtgactggtaaatattttgctattatagatttggctaatgtgttctattcactgcctatttcaacagcctttcagcctcagtttgccttcacctctgaagggacacaataaacatgtacctggctactcatgggatacctccacagttttgccattgtacactatctttgctggcaagatcttaactgtaccgagctttttctagatgtacaggtgtgatgttacattgatgacatccttccctgaggagatttatttgacacactcattcaggaaatacagatactcacaaaattgctcataaaatggtatggctgttgtgccacacgtagtgcaaggccctaccacttttcaatacctacacattatttgctaaactgaagaccattctgtctctgacactgtcagaaaagcagctattgaccctgtcagcacccacaacttcttttaggttcatttgtgttctggagacaaaacattcctcttttataaattttattgaagcccatttacgctatttcttacaaatcagttcatcttgaatgggggtcccctccaacaagaggttctagaatctgtcaaaattgcaatatgacactaatgacaattagtcactaacgacaatatcgttagtgaccccagatgcgcttcaccatagaggttttagcaacttcctcatttctccctctggaacatccatcattgccataagttgccaagggtttctgaggcaagagactgtcatccttggacctgttttatacaccattagagtgacaattgctagctgcatagtggactgtcttagaaatagaggctatcacaatccctcagcctgtgaccctccatatccagctgcctattgtgccttcggtcatggaagccatggcactacaagctgggcatggctactgaggcctctttgctacaagatggagaaaaacctgggtcttctgtcatataccacttggaggaaggggtagcctcccgtctttagttccttgctaaataccatggtgttgggggacccatcacccctctcccagaccctgtggctacctgcagagccccttgagatcaaatggagtgaaaaacaatggtttgtacaatttatggatgataccacaagcattgtatacaatggagtttgctggagagcttatgcgtttcatcctttaaccatgatgcttctgataaggacaggaacacaggtgtcagtacagttggccaaacttcaggcattcaccttagcactgtatgccctagccaacaattggccccatctgcacatttttacaggttcttgagccactgcctaagagttgccccatttggggaaagaactctgagaatctctaacctcacagatacccaaaatgtaaatcaagttaacacatttatcttcacatagtgaaggtcaaacataaggtctcaccaagagactccttattttccttcagaatttgaggcatcattgatagtgatgaaggcactcatttcatttcttagaatatacagtcctgggcttaatgaaggaatacaacaaaacatttactttctttacagacttcattctgaaggacttacagagcaccatactggcttcattaaacaaatgtatatttgattaaatgaacatggcacatttcagtcattagacaaacatcaggggtgaattgtaagattctgactctattttttcaagtttgctgactttttttttaagcttcaccttcttcccctctgccccacatcgggacaaattgataagaagctctggttgctccctccttgggggtcaggaaaagattcaaaccatggaagctccttcatgtgtataggaagccttacactgggccctaaccacaacgaaaacccaagcttgtctcctttccttgttctgtcaagccgtttcttacctgcttgggaagcctgaccttctccaccaagaaaatcttcatttaggtaagtattaaactttcttgtaccatcttggtgtgtgtaaccagtctcaacgtctaacctaagtttgggatgggggtcccttcttcctcttcacagtgtcaagtagtacctgattgaggttcttatttgcatttccctaatgactaatgatgttgaacgtatttccatgtccttatcggctatttgtatatcttctttagagaaatatctattcaagtcccttctttttaaattacattatttatatttttaattgtttagtcatatgactttttatgtattgtgggtattaggtccctaacagatacatgattttcaattgttgtcttccattttatgggttgtcttttcactttcttgatagtgtcttttgagtacaaaagtttttcattttagtgaagtccaagctgtctaatttttcttttatagcttgtgtttttgtgtcttatataaaaattgttacctaatcaagttcacagtgatttacacctatgctttcttctgtgagttttataattttagcttctacatgtaaatctttgatctcttttgagtttatttttgtatgtggtgtgagataggggtccagtttcatttgcatatagatatccagttgtcctggcaccattgtttgagagactatacttggcactcttgtcaaaagtcaattcaccataaatataagggtttatatctacactctcaattctgttcatcagtctatatgtctacaattattctagtaccttagaatcttagtaactgaagccttgtagtaagttttgatattgggaagtatgactcctccaactttgttccacgttttcaaaaggtgttttgaccattttgagttacttccattttagtattaattttagggtcagcttgtctgtttctgcacagaaggtatttagaatttcaataggaatttcagtgaatctatagatcagtttggagagtattgccatcttaacaatattaaatcttacaattaatgaaaccaagtgttttcccatttttaaaggtcttaaatttctttcagcaatattttgtagttttcagtgtacaagttgtggtcccacacattaaggtccccatacccagtattgttgacaagtctttcacctccttggctaaatttattcctaagtgttgaatttttcttttatgctactgtaaatggacttgttttcttttttaagttttattttatgtttaattgatacacaataattctatttatttatggggtacagtgtgatgtttcaatagatgtatacattgtgcagtgatcaaatcagggtatttagcatattatcacctcaaacatttatcatttccttgtggtaagaacactcaaaatccttcaactagttattttgaaatgtataacgcaatattgttaattatagtcattctactgttcaatagaacaacagaacttgttgctcctatttaactgtaattttgtaccctttaactagtctttctgcctctcttccaccccactttttccctctactctcctcagcctctggtaaccactattctaatctgtacttctatgagatcagcttttttaagattccacaaatgagtgagatcatgtgctgtttgtctttttgtgcctggcttatttcgcttagacttgttttcttaattttatttttggatttttcattgcaaggtagaactacaattgatttttgtttatgatcttgtaacctgcagctgtgctgaactcatttataagttctagtagtttttagtggattccttagaatttttacattcgagatcatgacatccacaaatagagatagttgtacttcttcctttataacttaagtgcctttcattgtgttttcttttaaaattgcccttgttagaatcttcagtacattgttgaagtggagagagtagacatccttgtctttttcgtgattttagagggaaagcttttgatcattaattatttattgatattattattattattagagacagggtctccctctgtcacccaggctggagtacagtggtgcaatctctgctcactgcagcctcgacctcccgggttcaagtgatcctcctgcctcagccccccaagtagctgagactacaggcacatgccaccttgccggatagtttttgtattttttgtagagactgggtttcgccatgttgcccaggctggtctcaaacacctggactcaagcaacctgcccgccttggcctcccaaagtgctaggattacaggcgtgagccactgtgcctgggcctgatctttaattattaagtatggtgtttctgtgactttttcctagatgccattatcaggttgaagaaatttccttctgttcctagtttaagggttttttttatgaaaagttatcgggcttaatcaaaggctttttctatatccattgagatggtcatgtggttttcattttttatgctgttagtatagtgtattacactgcttttcatatatttatccagctttttatttctggaatagatctcagtcatggtgtggagttctttttaatacgtgtcagaatttggtttgcttgtattttgttgaggattattgtgcttatattcataagggatattggtctgtaggtttcttttcttgtaatgcctctgtctggttttgctatcagaacaatactggcctcacagaataagttaggaagtgttccctcgtcttccctccttttaaggagtttgtgtagaatttagcagtgaagccgtcttggccttggcttttatttgtgggtagtgttttgattactaattcaatgtcttcacttgttataggtttctttatcttatctatttcttcctaagtcagattcagtagtttttgtttttctaggagtttgttttatttaagttaatctgattttttgccatacacttatttatagcatttttttataagattggaagtaatattccctctttcatttcttattctagtaatttgagtcttctatcctttttcttgtcattctggttaagggtttgtcaattttgttgatcttttggaagtaccaacttttattttcattgatggctctctattatttttcgattctctatgtcatttatttactccttggtctttgtattatttccttccttctgtttgctttgagtttagttttctttttatagttaattaagatgaaaagctagggtcattgttttagatctttcttgtttttcatatatttatccagctttttatttctagaatagatctcagtcatggtgtggagttctttttatacgtgtctgaatttggtttgctagtattttgttgaggattattgtgtttatattcataagggatattgtaatatagttattacaactataaattttcatcaataaaaaatactgctttcactgcatctcatatgttttggtaggttgtgtttaagttttcattaatttcaaagaactctctcatttcctgtgtagattcttatttgacctttggcttatttagaggtgtgttgtttaatttctacttttgaattactttacaaaatatctttctgttactgatttctaatttaattccattgtggttggtgaagatactttttattatttcagtccgttttatggagacttgttttatgatctaacatatggtctatcttcgatgagaatatttaatatgcatttgagaagaatgtgtattcatctgttactgggttaagtgttctatagtgtctattaggtgcagtcttctttttccttgttgatctcctgtctgattgtttttatctgttattgaaagtgggatattgaggcagccagaatatgttattgaattgttcatttctctcttcagttctgtcagtttttggaatctgttggtagatgaatgtaagtttatcatagttatatttttgtgatggattggcagcttaaagattgcaaaatgttattctttgtctgttttaccaatatttgttttaaagtctattttgtctgctattagtataaccactcctactcttttttgggtaatgtttatatggtatctctttttccattcttttacgttaaacttatttgtgcctttgaatctaaaatcattctcttgaagataatgtatagttgggccataactttttttgtcgatttaactagtctctctctttattggagagttcaatccattcacatttagtgcagttactcttcaggtagaatttacatgtgtgttttgttatctgtcctccttatgtcttatgtcacttttgtttttctattcttacattactgctttcatttgtcttaaatattttccactgtgccatttcaattcccttgttgtttctttgctatatattttggtattttttttttagttcattctttggagattaccattaacatctcaattgatgagaatctagttcagatttatatgaacttactgtcctagaatacaaaagctttgcttctttaatagcactgtaaccttctttatgttgttagtgtcacaaattacgtctttttgcactgtgtgtccatcaacgtagatttataattattgtggtagtcatgttttaagtcagactggaaaacataggaattgcaaattttaaaaaagcaacaactatatttatactgtttttaatatttacctatgtagttacctttaccagtgtactttatttcatcttatgatttcacgttactatctagtgtcctttcctttcagactgaaggacttcctttagtattgctcatagggcatctgccagctacttgatatctctttcagttttgtttatctgataatgtcccattttctccttcacttttgaaggatagttttacttcctttattagatatagaattcttgattgcagttttttttctttctgtaacttgaatatgtcttcccactgctttttggccatgacttctgaggagaagtcaactgttaaacttctgttttcttgtttgtgaagagttgtttttctcttattgctctttgggattttctccttgtttttggctttcagtatttttattatgatgtgcctatgtgtatatacttctcatttttcctacttggtgtttgtttgctttttagaatgtgtatgtaaacattttttcatcaaatttgtgatgctttcagctgtaatttgttcaaatatcttcttcctcttttctattttcttctctgattcccattatatgtattttggttgctagatgatttcttacaagtttctgaggctgtgtttatattgtctctgtgtgtgtgtgtgtgtgtgtgtgtgtgtctgtatatatatatatacacatacatatatacacgtatgtatatatacacatatatatacgtatatatacgtacatatatgtatatatacatatatatatatgcacagacacacacagtctcagaaacctgtgtgtgtgtgtgtgtgtgtgtgtgtgtgtgtgtgtgtaaaatttctgttcctcagactggatgatctgaattggactatcttgctgactatttttttctatcagtgtaaatctgctcttgagcccctctaatgaatttttcgtatctgttactttatatttgtagggggcttgaaggatttaggggcttatcaaagaaagacatatgtctatgaggtggcagtatcacacacaagctttattgggagatgtgttgacaggcttgcatgttggggaagtctctcacagtaggagcctgtccagaggccatggcttgggagttgctactctgaaggggaagaggccatggaatttccagagagggagattgtagaggggacttgacttacatgtttaggtgatggctactcagcagcacagtggggagtctctgggtcagagagagctctaaagggcaacaatgtgtcaaaagacaaaattacaacaaatttagtttaaagatctcacttggccgtatttgtgattctagaatcaggcaacactattccacaaaatagaatacttgttcaaatgagctgagagcagaagaggttgacttcgtagaggagaagggctgaagaagcaaagaacaaagtgtatttattgtatgtgtaaccactaaagtatctactcagtagcttagccatcattggataaagatttccttaaatgcctgggaccaataaattgcatcatctttaacaaagggatctgtatacatcttggggcatgcaacacttagccaggcagtttacaaccgtacattagccttcacttcctgattgcaaagagccgaaaagtcagttagaagtgagagtttatggccttctcaggtgtttcctgagcatgcacacagccctatacatgcagatggtcttctatattccctagaaaatatcagaactcttcaaatcccctattgatagcttattcctcagcttttcctttcattctttttatttagtttattgtttgctccaagtgttatcatttgtggaggggcttttagtatgggttttgcactgaatcaaacataaaccttttaagtagcgtcttctggggaaccaacagacaggacaaataatgacagttctttagaactgaagctttgggagttgatgccactgctaaacagctgagccagctaatgtagttctttgacagcacagaaatgtagggagaaatgagcagcccctggctgaaatgccgcagactctccttgttcttacttagttctgtagattttgttgccgttgatcaatccccagagactttaggtgattggctttgcttgttttgaccagttttattagatgtctctttggggaggagatttcactgagctcctcacatagccattccagaattcccataagtttggtgttgtatctaaaacctcattgctaaagcctaaggtcatgcaagttttctgttttcttctagaagttttataattttctgttttatatttagattcgtgatccattttgaattaattttcatgtgaagtgtgaggtttgtgtcataattttattttgcacatggattccagttgtttcagcaccattttttttggcaaagattgtccttctccattgaattacctttatgcttatgtaaaaaaaaatcagttgactaaatgaaataaactgattaaaaaataggcaaaagacctgaacaaagacacctcaccaaagaaaatatacagataatatataagcatgtgcaaagatgctcaacagcatatgttattaggaaattgtaagttaaaaaagataccactacacatttattagaatgttccaaatccaaaacactaagaacatcacatactggtggaaagatgaagcgacaggagctctcattctttcctggtgggaatacaaaatggtatagccactttggaaaacagtttgacagtttcttacaaaactaaatgtagtcttaccatatgatccagcgattgcgttccttgatatttactcaaatgggttgaaaacttatgtctacacaaaactctgcacataaatgtttatagtagctttattcctaattgccaaaatgtagaaacaatcaagatgtcctttagtaggtgaatggataaattgtagtgcgtccagacgatggagtttagtgccaaaaaagggctatgaaaagccttttcaagccatgaaaagatatggtggaatcatatgtgcatattactgagttttaaaataagccagtctgaaaaggctgcatatcccagctactcagaggctgaggtgggaggatggctttagcctgggaggcagaggttgcagtgagctgagattgcacagcaccccagcctggacaacagagcgagtccctgtctcaaaaaaacaaagaaaaaaaaaagaaagaaaaggctacatactgtatgattccaagtatttgacattctggaaaaggcaaaactatggagacagtaaaaagatcagtggcttccagggtttgggggttgggaatggatgaatagacggagcacatgggatttttagggcagtgaatctactctgtatggtactataatagtggatacatgtgtttatacatttgtgaaaacctatagaatgtacaacactgagagtaaaccccaatgtaaactatgaactttaggtgagaacgatatgtcaatataggtccatcaattataacaaatatacatacccttctggtgggagattttcatagtgagggtggttgtgcatatacgggagcagagagtatgtgaggaatctctaccttggactcagtttttatgtgaacctaaagcttatctaaaaactaaagtcaattttttaaaagtcaactgaaaaaaagaaatgcttctctctcccacaccttgccccaatcctcaggcaataataaatggttttgcggtatcaaaaaaaatctgtgattgtatttgtgtggatctatttatggcctccctattctgttctgttgatctatgtgtcatttcttttgctaatactatggcaccttgattactatagacttacactgcgacttgaaatcggataacatgagtcctctaacttggttttcctttttcagagttgtgatagctgttaggtcatttgccttttcatgtatattttttagattcagtttagctatgtctacaaaatgcttgctaaaattttgattggaattgtgtttatatggctttaattgagcattttatctctctctttgcatatcatttatacttgtttttcttaactttttagtggttaccctagttttcacagtacacatttttaatctaagtctttcaaatactattgtattgcttcctgtgtagtgtaggtaccttataagagttatcccccgtttctcccttgctttctttttgacattgctgtcatccctttcacttacttatatgctacagtcatttcatacattgtagtgtttttactttatacacagttacctcctagattgattaagaaaaataaaaagttttatattacttatatttatttttctctgactttctttatgaagattcaagtttctgacatgttgttttttttttgtgcctggagaacttcttttgacatttcttgcaggacatgtcagcttatggtatccagcagtttctctaccatgtaaacaaatcataagtgctagatcttcctgtctctccaaatgttcaagtggtgatttcccatgtggcctcagttctctgatgatttttaaaaagttattgattttcattttgtctagcttttcggtcttgtaagggcaggagtgacatcttcccagttctttacaatttggagctacaattagaggtgctcacatatgtatttttaaatttttcttgtggatatgttgccaaaaacagtaaaaagaaaacaggtgaaattaattttaataaagtattttattaaacccaaacaacaaaaataacattttaacatgtagtctgtataaaaatacttaagagctattccacattaaaaaaaaaactcttctaaatatcatatggattttttctacttgtatcacatctcactttgaactattgcatttcacgttatcagtaacccaatgcggtttgtggctattgcattgggcagcacatgtccaaagagaatatgtagaaagagaaggaaggagagttgaggatgaacttttggggatacagttaggtattaagcagaggaagagaggcctaaagacagagaaagaaaagtcagagaaaaattgaagacagcaaaagtataactgaaacaaagggaagaatatgtttcaaggaaaaataagtattcaaatagtgtcaaatgtggcgaggagctcagggtagatatggagtagatatgggaattgacaaatggaaaagaatagagaatacagaaatagaccagtgtgtttgtgtatgtgtgtgtgtgtgtgtgtatatgtatatatatgtgaaattagtaaatgaaagaggtgtcaacataaattaatagagcagagtatatcattcaatacatggtgatgggacaattgattatccatatagaataaaataaaataccaacaccaaaaacaaaccattaattttttatagattataaacccaattatgaaaagcaaaactttaatttttaaaaaaaaaaattaggggactgtttattatctcagggaagggaagggttgttgaaacagaatgtataaagaatgcctataaatcaatgataaaccatccaatccgaaaaatgggcaaagttatgaacaggtaatttataaaaaaggaaatacagaagtccaataaatacattgaaatgtggtcaattgcactaataacaaggacaagggactgaaaatcaaaataatgaaatgtcacttttaacatatcaggtaaaaattttattgtttgacaatacctggtattggcgtggttgtagggaaacagtagtcttcatatatggctgatgtgggtggaaagaaatacaatcacattcaaatgaaattaattgtcaaggatctagtaaaattgtagatgggcatttccttctgttgcaacatttccaattctaggagacatggaagaaaacattgcggtattacgtgatattgtgaaaaactggaaataaactaaattccccaactgttccaaattaataggggaatgatcaataactcatcagtcatcatctattcatacagtgcaatttaatatggcagtgaaaatgaagaaatcacatcaatatatatcagtgtcatcttaaaaacataatgctgattgagaaaagtgagttacagaacaatcacataatataccatttatataaacttaaaacatacaaaaatactatatattgctcatagatacagatgtgtttgaaaatgtatgtataaagaaggaatagaaatgatgcacaccatatcaaatttggttgcctctggggagaggaaaggataatggctaggggtgggtttaaagagtacttcatctttatctagaatgtttagtttatttcataaaatagatgaagcaagtgtgactacatttttaaaaatgttagcaattgttaattctgggtggatattctatattattctatatttttgagatatttccaaaataacaccaataccaattaaagtttataggagatgaggaaagaggaaaaaaaaaaaaggtagtacctggagaaagatgcagaaatctggaggagaaattactttcaaggtggtaaaaactcaaatagatttaactactggtgggaaggagcctagggagagggagtggttcaaagtacaggtgtaaggagagatgattaaagtaccaggacccagcttgtgaggagtgaagcacagccattttccccaactgatctatcatgtatttgtcacctaaggcaaaaatgtatttcttaactgatacagctatttgtaataaggtttcatatgctgtctcctttgtgttttatatatttatttatttatttactgagacagagtctcactctgtcaccaggctggagtgcagtggcacgatctcagctcactacaacctctgcttccctggttcaagagattctcctgcctcagcttcccaagtagccgggactacaggcgcgtgccaccacgcccagctaatttttgtatttttagtagagacagggtttcaccatgttggccagggtcttgatctcttgacctcatgatccaccttcctcggccttccaaagtgctgggattacaggcgtgagccactgcacccggccttcttggtgttttatatatgataactacatatcaagcaactgttattcccaatcttgacttgaaaaagtaacaaaatgttcctaacaaagttacactgagatgcaagtacagtgttttctgacatagctcttgcaaaaaatattggcaataaatgtatttaaaaataattttaggctggaggcagtggcttaagcctataatcccagcacttggggaggccaaggcaggtggattacctgagcccaggagttcaagaccagcctgggcaacacagggagaccccatctctacaaaaaaataaaagaattagtcaggcatggtggtgtgcacctgtggtcctagctactcaggaggctgaggtgggaggatcacttgagcccaggaagtgaaggctgcagtgagctgtgatctcaccactggactccagcctgggcgacagagtcagttgctgcctcagaaattaaattaaattataaataaataaatacataataattttaatgattaagaaaatttcaggaattagtaagttcccaatattgttgtttgggcattggaagcaatgtactatgaatctttaaattttccaaatacagagtttccaaaagataaatggacatcctcactgggctctatgggtaacttccttttcatcttctcccactttgcaggctaaacaggcactctgcacttttttcctttttaaagaaattatttttatttctaattattatggctatataatagttgtatatatttatggcatacatgggatgttttgatacaagcatataatgtgtcatgatgaagttagtgtttatcatttgtgttaggaacattccaattccactctgttagttattttatttttattttattattcttacttttttgaaagaagatctcactctgtcacccaggctggagtgcagtggtgcgcaggcggttcactgcagctccgccttccgggctcaggttcctcccacctcagcctcctgagtagctgggactataggcgcgcaccaccacacctggctaatttttgtatttttagtagggatggggtttcaccatgttgcccaggctggtctcgaactcctacgctcaagggatctgcccaccttggcctcccaaagtcctgggattacaggcatgagccactgcactcgatctcctttagttatttttaaatatgcgataaattattgttaactatagtcaccctattgtgctactgaatactagatcttattcattctatctaactgtatttttgtacccattaaccactcccactttatctctccctctctgctactcttagcctctggtaaccatcattctactctctccatgagttcagttttttttttagcttccacatatgaatgcaaacatgtgatatttatctttttgactccacttcttttttcccatccaggctccatggaggggaaagagaagggaaaaggtagacaagaaagattggaaacttggtcttgaccctgctactcacgagccttaatgtgtcttcttacctcttcttttcctcacctgccaaaacctctgcagccctacttctgcatgcctccccaccttcactcttcaggaattactaggaagttctactcatactgggagtcaaatgggatatcaaggagataggtaggagaatcagcagtactaccagggatatagcactggaagataggttcttagcatctcagtgttagcccccttttattaatttctcataaaagcacattgttttattagtggtctttatctacaatagtattggaaaatttcagcaccaacataggtcaagcaatcttatgtagtccaacgtaagtacctaactaccatttatggcattttctttttttaaatggaaaactgttttgtaatgcaattttcttataaatggtagtttggggctacatttaattcatgaaagttagtaagaaagtagaagaagaataaaagtttgagttgacaaatcccatatgtgaatcctttgaaatgtttattaaactaaagcattatattgtggttagatttcaggaggtaaaaagtggtagaaattactttatttagttttttttttttctacaggaataaggtagtggaattgctctctgataccctaagtcagtcaaccagtctctcccaccccacacacatacatttagttttttctatatttctcaaatgtgaggtacctttaatttcttaaaaaatcttagtaagtgtgctgttgctgaatcaattttttttacattaagtactacagggtttcatctgtcattactttttgtgctaatcattttgtaacttttatctgaataattcaatacttgtaactaaattatgtttgaagattcttaatctatataggataaaacttgttttattacatttcatttattagtgttactcatattagtaaagtgtctactttttctctatggttgtcagaagctggagaacaccaagtaatttaagatttatttgatttgagactttaccatcgtcaggatatttaaagatatttaactagggacagtatatgtgttaaaagctgacttctactttataaaatcacgaaatattaaaatatgcagaaaagtgtaaataataaaacaatgaacacttttgcatttattgcctaactcaatacatttagaaaatcgcaatgcaattgaagccccctgtatgaacccccaatcacatcctactcctttccctctacatgttgccattatcttcaattcagtatttatcattcctctgcatgtcttttgattttcctacttatataaatatcacttgaaatatatgaaattattttgcttttttgaacattatatggtagaaatatatgcattcttctacaaacttgcttttttattgttcatcatggtatttgtaagactcattgatgaatgtaaaactcatgcatctatttataatcccgtataaaatcataattaaaagtctcactccattttttaatgtttgactgctgacagctttgaagtcttatctctccctcttctccctctgtcccacatctgggcaagataagaaagccaagatgctgcattccttaccaccagtgtaaagttcaaaccacaggtgagaatcctcattccagccccacccctaaccaccataaaaacccaagccaatcttctgtccttgctctatcaagccatttttggatgtgtctgagagccacccctgctctctgcagaaagcctcattatgtgagtaatcagcttttttatgaatattggtgtgtgtttgtttggtatcattggtgttgacatttaaaccaaattttgaactggagtccatcctgtccttgtggagtattcaaaaaattatttcagtgttcttttgttaatggatattaggttgtttccttttttttatagttgaaaacactgtttctatggatactttttattttttcttattgatttgtagaagttacatttatattctggatatggattccttgttagtgttgcaaatatctgctctcagtccgtagttagtctttttaccttaatggtttcttttgtagtacagaggtgatgaattttgatataaattttgatcaaatctaccagtctatttatgattgatctttgtatctttaagaaatatttctctgatttggagactataaaaatgctcttctaaatgttctaaaacctttaaagttgatttttcccatttaggactttgatctatttattttttgttgtataaattatttcctttcttgtaatgtctgtctggttttcgtatcaggatcatgctggcctcatagaatgagttaggaagtatttgctattcttgaattttctggaaaagtttgtgtagaactggtattatttcttttttaaatgttggtagaatttgcttgtgaagtcgtctgactctttaaaatttcgttgtgggaaggttatacagatgctccttgatttacaatggtgttaaatcccaataaagctgtttaagttgaaaatactgtaagttgaaagtgcatttaatacacttatcctagcaaacattgtagcttagcttagcctaccttaaacatgcttagaacacttaatattagcctacagttcggcaaaatcatctaacacggagcttcttttataataaattacatgaatatctcatgtaatttattgaatactgtgctgaaagtgaaaagcagaatggttgtattggtactcaaagtatattttttatggaatgtatattgcttttgtgtcatcgtaaagttgaaagatcataagttgaaccatcataagttgggaattgtctgtactactaatttagtttctttgttcctttgttactaatgtgtctttttgtttttcctggattgtttccagagtttttaaaaaaatctcttaatcagattgattgtgatgagccttgtagtttccttcatgtttcttttgcaccaaatttgttgatattttttgatttggaagttaaaattatcgctaaaataatggcaaaacccacaattaatagtaacatttgaagaaacagtggctaagaattttagctgccttcctctcccgggactctgagcttcatctccttacctcaggggatctgccaggtgaaaagtattaatacttctctcatccgctttggggactttacctgtgtattaagttgcttgccattgttcaacagtccactgatatttttcatacttcaaaaaaattcttttctgtttcattttggatgatttttatttccattttttcaaattctttaatctttccttttccatagtttaatatgtcatttatccaatttgtcgtatttttaagctcagatattattatttacatctctaaaattttaatttgggcgtctttgttacagttttccatgcctctacttaactttgtaaatgaatagattatgtcataactttttaaatgtccttgtctggtaactctaacatctgcatcaattcttggttggtttcaatttattgatttttttttttttttattttgtaatttcaagcttctttgcattgctggtgatgtttgtttacattcaagccttgtggattttaccttgttggatgctagatatttttatataactaaaaatttcttgagctttattctggaatgtgataaaactacatggaaacagtttgatccttttatgtcttgcttttaagattgattaggtggaaccagggtggtgctcagtctacggaaaattattccttgctggctgttggtaacaggtgctgttcctgtctcagtgtaagtgatgaaaactgttctttctagtgatttcaaatggttctttcccctgccttgggtagttgcctctgtatacactaatgtgtactctgttttttttttttttgagatggagtctcgctctgtctcccaggctggagtgcagtggcacgatctcagctcactgcaacctctgcctcccgggttttacgccattctcctgcctcagcctcccgagtagctgggactacaggcatgcaccacctacgcccggctagttttttttgtatttttagtagagatgggggtttcaccatgttagccaggatggtctcgaactcctgatcttgtgatccgcccgcctcggcctcccaaagtgctgggattacaagtatgagccaccgcgcctggcaatgtatacgctgttgaatactcaatggagcctttgcagatctcaggagttctttttctgcactgtttccccattctgctaactattacctgcagattttagctgccttcttctcactggactctgagctttgtctccttacctcaggggatctgccaggttctgactcagttattacccttgcctgtggcatgatctgaaaattctctcagggaagtacgctggggcatttatagggtcaccttgtttctttaccatttctcaaggattattggccctcactacctgatatctattgttgtgagaataatttgctttttaatttttcaacaagttgggtaaatggtccctgttattccatcttgcccagaagtgcaagttcagctgagagtttaaaaagtgttaagattctcataagttttttatgtagggaatcttatcaactctaaatattaacaattccctttattcatttctaatccttactctcttctgctttctccttttccttcttcctcttacttcctcccacacctctggatagggccttcagtataatgaatgaaagggatgatagcagtgattcctgactcccattattaaagggggaacacatttctaatgtcattatttgttttttacaatgaagcctttgtgctcttctttcacatcagtttacaagtgctgtttgacaagaatttcctgtaagcccttaagttattgagtaacagtttagtgcttaagttaactgtcaaacaacatttattatatgccatctttcaaagtacttacctatattaacgcatgagaggcccaaaacaaacataagaggtaggtactgttattatccccacttcacatatgagagacggtgaggttaaatacatttcctaaggttgcacataataaatggtgaagctgagattcgagtctaagaaacctggcactagagcccaggctgcttctgcactgtatttctctgctcttaactaatatgagagtattaaatgcaattgtcagttggttcatttaaatgaccacaaagacatttctagcacttagtgttcacatttcaattatttatgccagccaagtaaccactatcaacaaaagttacaaacagtagatatttcactataggaaaagatgggagtaaaattgtagccctcttagcaggttggttttgaggaatttaacttactagattcaagttacgtgattcctgctatcccatgagttttgttggctgcaggccagggattggctgtttactactttccgctgtctcagtgctgtaataccctggcctaatggctctaattaactccatatatttgttccagaaagatgaagaggttctgtatagttaagaatcaataaaatacaaattgttgcttaggaaaccccgtgtactcttagtgtcagtaattaactttttttctggagaagtttaagaaacaggcccaagccattcaatagccatttgtgaagctgatatttaaagaaatgtagatgctgcattagaatctttaggcatctacaccaagaatgcagtgattccatcacaaaaatttcttttctttcctattggcagattataggaataaagtatttctgatttaactaactcaggtaccagggaatatttgggcaaattagtacatctcttgttttgttttttaaaattttttcataaaatccagatcctgcacaataataaatctcttaatttattagtagctgctttcttaaaaggatttatgaacataactttctgctttactaatacagagctgaagcagacttaggaccgatgagaagaatgtaaactaaaaatcatgtctttatgaaaataggaatttcttcctaagatctgggtgaggtttctcagtggcatacattgacctcagtggtcaggatacaaaactcacacagacgataaagctgacgaagtggaggaaattggcttgcaaacacttggagaaatcacttcaaagtaaaaccactttcaaattgctttttttttctgactatggaatagtgtttagcatgtttcagcaaaagtctgcacaacaatacactagatataaattttaaaagacaaatagcatcacagagcgacactcagggagagatctatttctgtagagtataagtggcttaagaacctaaatgtggatattttaaaattaaaaaaatcaaacctcttccactttggagattatttatgtgaaggtttcttatggccattcctctgccagagctctctagaagagcagagtgtttcttaattttattccagtcagattcactactattcgaacatttatcccaaatacttatactctcaatacttaaatttatctcaatctatcaagtctcactgcttctccttttctttttattctccacatatttaaagttactagtgtgtccacattagcagaattccttgtgtccaggaagatgtgtcttctgtgtactaaaaagcaatatcctcctgtcctatgtgtacagaaatggatccaggcagaaacctttgagtagtcaactgcatgagcagcttcagatccatgacaagtccttcccttcctgttccatacctgctcttttgttctaagagaaaactgttttataagaaaatatgtatgcttctgtctctattattatataaaattcagccttcctccatttctgccagaaaaaaatatgttctttaagcttgcatttttttctataatcttaataaaattttagaacttagccttaaaaattcaaggctcataattgacaaaatgagtcttcatgcctatagctgcaaagggatacatgccatcttgtattataaaaccaattccatgaatcttatttgatatagaaatcaatatgtctgcaaatatttttatctggttttcttttgctgcatggagatttgtgtgaatatacagaactgttaccaacctgtggtcttcttggttaatagaaatctgtccttcaaatttttcatgtcaacaaatggagtcctgtaagacaatggttctcaaaatgtggtccagggagccctgggtgtccatgtgaccctttcaaggccttttcaagattgaaactattttcaataacgctaatacattcgctttcaaaatttcattatcttgcagtgttacagtggattttaaaaagagactttctgttgtgagatatcataacagattgggtgaggaatcagatatgagaatttagttgtcagctattaagtcaaacattaaagagatttgcagaattgtaaatcagtgccactcttcccactatttgttttattttggaaaatacagttattcttcataagataggttatttatattaacatgtaatgagttttgttattatttaaaagtaagtgaataaatatttaaatttctaatacactaaatatggatagatagaacccacatgaaccaaggccttttggggtcctcaaaaaaattttttcggagtataaaaggctctgcaaaacaaaaagtttgagaaccgctgctcaagattccaaagacttttttttttaaattttattattattatattttaagttttagggtacatgtgcacaacgtgtagattagttacatatgtatacatgtgccatgttggtgtgctgcacccattaactcgtcatttagcattaggtatatctcctaatgctatccctccccccttcccccaccccacaacggtccccagagtgtgatgttccccttcctgtgtccatgtgttctcattgttcaattcccacctatgagtgagaacatgtggtgtttggttttttgtccttgcgatagtttactgagaatgatgatttccaatttcatccatgtccctacaaaggacatgagctcatcattttttatggctgcatagtattccatggtgtatatgtgccacattttcttaatccagtctatcattgttggacatttgggttggttccaagtctttgctattgtgaatagtgctgcaataaacatacatgtgcatgtgtctttatagcagcatgatttatagtcctttgagtatatacccagtaatgggatggctgggtcaaatggtatttctagttctagatccctgaggaattgccacactgacttccacaatggttgaactagtttacagtgccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcatttcttcatgtgtgttttggctgcataaatgtcttcttttgagaagtgtctgttcatatccttcgcccactttttgatggggttgtttgtttttttcttgtaaatttgtttgagttcattgtagattctggatattagccctttgtcagatgagtaggttgcaaaaattttctcccattctgtagggtgcctgttcactctgatggtggtttcttttgctgtgcagaagctctttagtttaattagatcccatttgtcaattttggcttttgttgccattgcttttggtgttttagacatgaagtccttgcccatgcctatgtcctgaatggtattgcctaagttttcttctagggtttttatggttttaggtctaacatgtaagtctttaatccatcttgaattagtttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatctctgttttggtaccagtaccgtgctgttttggttactgtagccttgtagtatagtttaaagtcaggtagcgtgatgcctccagctttattcttttggcttaggattgaattggcaatgcgggctcttttttggttccatatgaacttgaaagtagttttttccaattctgtgaagaaagtcaagattccaaagactttagaaactgttgccatgtcctctgagaaaagcttcagaagaaaaacctatagttctcattggttgtcttaattgatgatttgttaccctagtaataatgttgtaatgaacttacatgtattctcaaacagtgcagatacttttggtgttttcttctctacctcattcatggaggagcaaataaaaacttacaagcctgttagttttgtaatatatttgaagagcctttgtttatttagtttaacactgtactatgtgacacattaatagaagagtttccggtttgttggtgaggtagtcagtttttagtagtaggaaaagctttattttcaacattgtgatttggggactttgttgtttgaatgctttggtttgctccactttctcatgtcttttttctcaccttctacatgtagtatacttgctatagctttaagttccaattgcatatcttctttatgtaaaatgatataatcttgagtcctgctaagttaggtgggccaagggagaaaaggcaatgagcagaggccccaaaatgttaatggtgttcctatgagatgaggtcaggctatcagaagctcatacagctgtagacactttaaagacatcacttctctttattcttagtggattttatattttgagtatgatttgacgttcttttaatgtgccaacaatattagataccactttattaattaattatttataagatggggtatcactctgacacccaggctggggtgcagtggagtggtcttggctcactgcatcctccacctccgaggctcaagcgatcctcccacctcaactccctgagtagctgggaccacaggtgcgcaccaccatggctggctaattttttttttttttttatgtttggtaaaaatggggtttcaccatgttgcccaggctggtctctaactcctgagttcaagtgatccacccgcctcagcctcccagagttctgggattataggcatgtgccactacacccagctaggtgtcacattattaaacatgcttgaagtaataacttctggccttataaagagtttttataagtctccttttgagggctttattttcttggagaaggctttgttgccaatgtttgttgtcaattgaacacattaactgttgcttctcctttcttagacatgagccagggtgtgacttctcattctgcccctttccaggttcccagattgtttttgtggtaagctcaataatgtcccctaaaggtgttcacattctgaaccccagaacttgtcagtatgttaatttacatgttacaagggacttgcagatatgattaagactttgaaatgaggggattatcctggattattaggatgggcccaatgtgatacaagggtccttataagatggagacaggggaattagagttatagagtgaagatgtaagactgacaagtggtcagagaggagagaagatgctatcttgatggctttgaagatggaggaagggactgtgatcccaggaatggaaacagcctctagaaaatggaaaggaccagtaaatagcatctcacctagagcctccagaagaaacgaacctcactaacagcttaattttaaaccagggaagtaaatttttagactttttacctccagaattataagatgataaattcatattgttttagctactaagtttttggtaatttttttatattagcagtaagaaaccaacacagattttggtacctggaagtagagtgctgctgtaccaagcacctaaaaatgtggaagtggctttggaattgggtaatggttgagaatggaaaaattttgagaatacgtggaagaattttgagaatgattgaggatggagaattttgagaagtgtgatagaaaaagcctatatttctttgaattctttgaattgttagtagaaacatagatgttaaacattctaatagtgagggcccagaaggaagtgaggcacatatcagagaaaacctatattatcctaaagaaaatctgtatcagcttgttaaaaatacagacattaaaaaagcttcatgtgaaggcagatatgtagactttaaaggtattgctggtgacagcacagaaggaaataaggaacattttattgctcctctcttagatatgagccagcatgtgacttctccctctgcccctttccaggttcccaaattgtttctatggtaagttgaataatggccccctaaagatgttcacattctaatccccagaactgaagaaaagaagatccttactatatagtggcagaaagcttagctgaatgtggcttacagttttgtagtaagcagacattgtaagcaataagcttggatatttagctgagatttccaagcaaagtgttaaaagtatggctagcttcttctcgatgctcattaaaatgtgacaagaatgagagaaattgaaggaagaactgttaagcaaaaatgaactaggacttgatagtttgggaaattctcagcctatccagactgcaaatgatgttaaaatttggagattcacagtcaggaaagcttactatggagagaaagccaaagcaggcagtgtggcatcttctcttctctctgatctctgcagcatcttctcttctctctgatctcagtcacacacaaaggtgtgactggacagccttttgctactgccttggaagagggctttgtgaagagattaggcatgcatctcataaatcctctaagccaggaatagagatggaattatccaggatagatatctggaggaagtccttgtctaatggagtgaatactgagacatacacaagagacccacaaggcattttagaaggttgtagcagcagaaacactaccagcttggactgaaagggacagagagagaatggaatgaaagaaggctgttggacttctaaaattctacaggcagaagacaggctgataaaaatatttagcagtaggctgggcgtggtggcacatgcctgtaatcccagcgctttgggaggttgaggcaggaggaacacgaggtcaagagatcgagaccatcctggccaacacagtgaaaccccgtctctaccaaaaatacaaaaattagttgggcatggtggtgcgtgcctgtagtcccagctactcaggaggctgaggcaggagaatcgcttgaacgcaggagaatcgcttgaacccaggaggcggaggttgcagtgagcaaagatcacaccactgcactccagcctggcgacagagtgagactctgtctcaaaaacaagcaacaaaacaaaacaaacaaacaaaaaatttagctgtaaatacatgctaccttttatgaaaaagaatgactctgaaggtggaatgagcctgggtccagagggtagacccttgagccacagaggatatttttaggcctttagcctaatggagtatgactggttagattttaaaattgcttgggactggtagctctttttttctctttcgtttttctcccattttggatgggaatgcctgtaactatcaaactatgcctgtttcacctttgtattttgggagcagataattcgttttgcagtttaacaggtccactgatggaggtgaatttttccccaggatcctttatatctagagcctcacccatacctaaatgagatgacttacatgatgagatttgagacttttgagctgatgagacttacatgagattttggacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtttttgtcatgttgcccaggctggtcttgaattcctgagctcaagtgatccacacacctcagcctctcaaagcgctgggattacaggcatgagccaccgtgcccggcccgatgtgaatctttgggggccagagagtggactatcataggctgaataatggcctccaaagatgtccacattctaatccctgaaacttgtgaatatatgaccttacacgatgaaaagagactttgcagatatgattaagttaaggatagatattaaggtggggagattatcctgtattacccaatgtagtcgcaaagttccttataagggaggcaggagatttggagtcagaaagggaagatacaaggttggaagcagagatcagagagaagagaagatgctgcagtgcctactttgaagatggaagatggagccacgagccaaggaatgtaggtagactgtggaagctagaaactgcagggaactggattttccccaaaagcctccagaagtaatgctctgtattgacaccttaattttagcccagtgaaacagattttgcatttctgactatattagttcattctcgcactggtatagagaaatgcctgagactgggtaatttacaaagaaaagaggtttaattggctcacagttctgcaggctgtacaggaaacatagcagcttctgcttctggggaggcctcagaaaacttaacaatcatggcagaaggcatgtcttacgtggccggagcaggtggaagagagagagggggaaggtactatacacttttaaaacaaccagatcttgtgataactcattcactcattatcacaagaacagcaccaagtggatggtgctaaaccattcatgagaactccactctatgatccaaccacctcccatcaggccccacctccaacattggggattataattgaacatgagatttgggtgggaacagagatccaaaccgtatcagtgactttcacaactataagaaaatacatttgtattgttttaagcaactaagtttgtcataatttgttatagcagcaacaggatgattacaacttcttaaacaaacaaatatgtatctgtttaaaatgttgattatcaaatacatcaaacctatagaaaagaatcagaaaataacagggattcactatccagattaaaataaacattttaccacactttatttcaatgtcttgttaaaaagaaataaagtgtacaaatacaccttcagctcactctcatcccatttcccttgtttcctctgtaaaagtaaccattattctgagattggtatgtatccttttgggtcacgtttttggacatatacccctaaaatacatatagtattgttttctacgttctaaaatattgtataaatgctatcatactgtacctgttatttaactccttattcatcaacatgtttttagatttattgagttcatttttaactgctatatagtattgttgcagaattttgctccttagttcagctagaactgggttcttgtcacaagaccaggaaggattaggaacatggatacattgaagggtgaggggaatggaatttattgggtgaaaaggaaaaaaaaaaatcagcaaggggatcctgccagcagcaggctcccatctcacagattgaatgccaggccaccacacaggaaccgaagatgaagaggccaggctcctccccactgcaaagagtgaacttcccatggctccaccccattctcccagtgggcaaactagtcggagattctccgggggaccctcctcctatctctttctcctgcatttatcagtattacattttgtggtgtttatctttccattcctgatatgtcatataccaaatatggacatttacttgttgccagttttttcaatattacaatgctgaaatgagcattcttgtacaaatttcctgtgtacgtgtgcaagattttctctagaataggtatctagaagaggaattactgtatagtaagttatgtacatcttcagttagctagatgttgaaaaattgtggctgtgacactttaatttcaatttgtctccctatattttcagcactttgtattgttggacttttaaatttttgtcagtattatgggtgtgaaatggtatctaactttaatgtctcagataaactagggggatttgacatcttttcatatattgactggccattcttttttcatcttctgtgatttgccactttacatcctcttcctattgtgttgggtcttttttatatacctgcaagacttgttgttatatatttatatacaatggatatttatgttgattttacagtttataatatcttctagtctgcggcctgtcttttccatctgcttattgtgtattttaaccaagaccaccctcaggcttgatgatttgctagaaggattcacagaacttacaaaagctgttatactcatggttacaatttattaggatgtgtgacggtgcatgtgaagtgttgtcagccagggaagcatacctgaaccttggtgtcccgggcttttaaaattgggaatcagtcacataagaatgcagcacttgcatgactagccttagttactgagactacagcctcccctcacccataaagcacaaaaacaggcacttaccacaaatcacagcatttgcacaaactatctgatcataatggtactgtatggcccaaggcctcaggcatatgaaaacaacgtgaagcaaaatatgccggtggcttgagaactcatctcccaggaattgggcaagggccagccactcctggagacaggactttcctgagaatttgcagggtttgggggtttttgagttaaccctttcctgcacaggaggtatatattttaatagtcacatttatcttccttttccttcatgttgtactttttctgttttttatttcttttttttctctttttttttcttgcttccagtgggattaagatcttttctgttttttttttcatctcgtttaaggaattcttccttaccttgatgtcataaagatattctactataaattctcatgtaaaattttatagtttccttttcacaatttagctctgtggtccacttggaatttctttttgtagaaaagaaattctattagaagaatgtagggatgtaaggatcttacttaatttttttctgaatgattaatgagtggttccaggactattaattattctgttatttctgcacagatttataatgttatctcagtcgtataccaatttcctatatatatgtgtgtctgcttctaggctttctattctgttccattggttcgtttgtctatttctgtagctttataatgcatcttaatatttggtagggaaaggcctcttattcctctccctcaaaaatatgttcttttcatatgagtttaaggtcagcttactttaaatcttaaggtctgtaagaaacattgagatttgattagagctgcattttgtttatagattagagacagaactggcatctttacaaaaatgaaggtggttcatctctccctttatataggtgtttttcattattttgagaaagttttataagtttttttataagtatctaattcatagtttgctagatatatttttgtgtgcctattgctctcatgaatatttctaaattacattttgttattggttgtgccaggtgtataggaatgcttgattctggtatattgttgttaaatccatccaccttgctgacctctctctctaagtccaattatttgtttatatattttgctagggttttatataaatattatataaaacatgcttaaaagtacatgaaccataactatagagctaaatgaaatgtcacaaagtgtttttggtttatttatgtaatttgtgaataatttttttcccttttccttataccgccagaatttgatgtctttctatgtaaaataaaatagaatttcttttctgaaataatctctttttttttagacagagtcttgctctgtcgcccaggctggagtgcagtggcatgatctcggctcactgcaacctctgcctctgaggttcaagcaattcccctgcctagctgggactacaggtgcgcaacaccacgcctgtttaactttttatatttttagtagagatggggttttgccatgttggccaggctggtctcaaactcctggcctcaagtgatctgcccacctcgacctcccaaagtgctgggattacagacgtgaggcactgcgcccggcctgaaacaattttatttaagcacctgaggaggctcacgctctagtgagctgtgttggatgtgtcaatgcttttcaacttatcaaagaaaggaaattaccagtatttggaaattccaacagaacttaacaaaagggcctacagagtggtgatttcagttagttgaccacagtccaggatttggttctgagcatttgtgaaatgttgaaacaagacttggtggtaaacaaatacaaattaatttactgagactaacatagatacgggtacagagagaaaaacacacacatcatactaatgtattatttccactggtcaacacactcaggccttttatccagggcatgtcagtttcagtattgaggtacatgggaagtcaaactaagaaaacaaaatgctggctgggcgcagtggctcacacctttaataccagcactttgggaggccaaggcaggcacatcacctgaggtcaggagtttgagaccagcctggccaacatgatgaaaccctgtctctaccaaaaatacaaaaaattagccaggcatggtggcaggtgcctgtaatcccagctactcgggaggctgaggtaggagatttgcttgaacccgggaggtggaggttgcagtgagctgagatggtgccattgcactccagcctgggcgacaagagtgaaactccatctcaaaaacaaacaaacaaaaaaaagagaaagcaaaattctgtttactgtgacctagcactaaagcaaaggaaagtaaggaatcttgtaaacgtggaatcctttgtattaaggaatatattcagttactctgccttctctttatcacaccccaagcagtttgagaggcagcaagatgcagtggaaaagtactgggtttgataactgattgacagggatttgaatcctagctctttgtggatggaccttaggcaagttactgcacttaacttctcagagtttccattttctcactgttgaaatagaaatcatgacattgttaatttaaaagaaatacagcatctcaaagtaattattatagagtaaatccagcagaatcacaggcttgcatttgcttatccaggcctgtgagtaaagaagaaagtgccagtcaatgattatgcctaatttgccggaataaatcctagtaccagtctgtttccaagtacaagtagtccccgcttatcctccagggatacattccaagaccttcagtggatgcctgaaactgttgacagtactgaaccctatacatacactgtttttttcctatacataatgtacctgtaaattaggcacagttaacaacaataactaataatgaaatagaaagattataacaatagactgtaataacagttatggtaatgtggtctctttctctcttttctctcaaaatatcttattgcaccatacttaccttcttgtgatgttgagagatgataacctagccagctactagatgactcatagacagggagcatctatagcacagatacgctagacaaagggaggattcatggcccaggtggtacagccagagatttcatcatgctattcaggacagtgtgcaatttagaatatatgaattgtttatttctggaatttcccatttaatatttttggactgtagtttactgcaggtaactgaaactgcagaaagtgaaaccacagataagggggtactgctgtatagagatggcaactacaactttactaccagatgtattagtttcctattactgctgtagtaaattatgacaaacgtagtttaaaccacacacttttaatgttacaattctggaggttagtggtcctaaaatcaaggtgttggcagggctacccttcccttagggaccgctagaaaataatctgtcttcttgctttttccagtttctaaaggccacctaccttccttggctcctgctccctttctccatcttcagacataacagcaaagcattttcagctctctgactctgacctgctcccgttgccatctctcctctgactctgatcctcctgcctccttataaggatcccagtaattacactgggctcaccaagataatccaggataatctcttcatctcagaatcttaactcagtcacatctgcaaagcccatttgccatgtaaggtaacatcttcacaagggttgggatttgaacatcttgggaggaccattattctgcttaccacaccaggttaatgaattaccaagtaaaatacctaattagaattacacatctcttttgtaggttattttcactgaaacaggcattaatttctaaagttgtaggagtcataaaatggctttatttagacaatacttccaaggaaagatttgtattaacagagaatagaactagttggtaacagttacaaatattctcaaatcaccatattgcaaaggggaacaagatttacattcttgttaaagttctcaatttaatgcctttttaaattcagattatttgaaattattgtgcagcaaaatggtttccacgcctccacagcagcaggggagcgggcacagagccttcatatctttctgagtttccttttgttaattctgaagatttgcatttgtaaagctaggctctggaatttcttagctagttttaaataaaaaacatgtctgggtcctcgttatgctggcagaaatggagaaaaagctgaaaggattttattaccaatgaaattctatattttgtgccttgtaaagtagttgtgaagatttaatgtgaccacttacaagccctgactactgcttgatgaatgagagcagtttgagtctcttaccttcttttttgtactttccgcccttttgtatcttcctgctgagctcagataatttcgtcttacctgtctttaaatttaaattctctacttaatcttctaattaaagctatcccttgagtttttaattttgagtactgtattttttttctaaatgtttgattaggttcaattatggtctgccatttgttatggcttcctgttgcttggtaagatcttcaagttttttatttatctctttatgcatagtaaacatagtcgtcttatagtttgtgtttgataatcctattgtttaaagtctttttgtgaacatttctgttgtcagctgatcctgctgatttgcttctttatctaattcaaggctcaaggttcccagggcaagttatgtgatccaaatctgagctgcaaaactggcctgcttccattcaccctcccctttagggggtagccctttgaggtcccagctcattgttgggaatgtctcctcttagttttcccacttagtgtagctctgggttttaatctcttatctcttttgcctttcaaggcagccaaaatgaaagctgaaatttttggaatagacaaatgcccttaggacagaagttgcttcactgctctatttacctctaggttccccatttcccaggaatgttgccctagtgtttccatactgccattttattgtttttaagtaggtgttactacttttctttcatcaagatttttaaaatttgttttcaacctgatgattggtccaaataatgtggcaggcaatcatcagaactagaaacatttcttataactccttgctacattttctttgagattagatttaggctcagaacttcattatcttttgggttttgtttcttctgttttatagaggacacatctgatgctcagaaaagtacaaatacttgctcaaggtcacatagcaagtaagtggtaatattgggctttgaacccagctctgtccaaccctgaaacctacactgtgtcagtttttgttcctgggttctggaacttctttcttttaggaagcaggtaaatgactcgtgattttcttccttgagttttatctctcaaggtcaagaccatctatctccctgtctcttggaagcacacacagttctgtgcttttttcacaaggtccttgtcctgtttctaagacgtcctgataaataagtatccctttctaccacccaccttgtacctttcagaactgaattcagggacattcagtatccaactgtaaccataaagtttgatttccttttcaactgcagtattttcctcaaaagacctagatgaattccctgctgaatttggaaagagctaaggacaaagtgacccgggaagcaatccttttagatgaaaggaggagggagaatgatacaagtaggggttagagaacttacagtttagttgtatagtggtgggatagttgaagattttggattggtgaatgcccacaaggcaccttgtcatggtgacaaatacaggagctttggagccagacccacttcagctgaatatcagttcacctacatattaactctaaaatgttgggcaagtcagcttccctctcttgaccatcagtttcttcatccacaaacttggaataataatagcaaactttcaaggtttccgtgtgaaataccaatgatgtatttcagtgaagtgtttgtgtttggtgcatgcttactaaatggttgtggtagttattattattgttgtccccctcaaacttttcatctggtgggtgccctaagaccaggcaggagagttcatttttcatttgtgtgtatgcccagttactcctctctcctctgttgcatcatcttcttcagtctcctgaagatctcttaccgtctacgttcttcccaatccttgctttcctctcctagttctacacagtcaacacctcctttgttcagataatcttcccatttccctactcaatttaatctcttttcattgcctctgcattgtcctccagataaaccagtcatcctcatatcactttgtttcttcatgtccctctctccctgatttgggaggccaccccaaagtgagacatatcactgggtctcagcaggccttaatttctcagctgattctctgtcttattttgtcagcttcttttcattaagtaaaagttatgtttttctgtgtattattttttaagctgtttagttatggatatcttccttttttacgtattttacattataaaagtagagacatgctcattttgaagattttagagaacaacaaaactttattaggaaggaaataaaagtgacccacagttttattaactagagataaatactattcagtaattgatatatttcttttcagtatatacagttttgtatcatttgctaggactgtgtaccacagtctgggtggcttaaacaatagaaatttattttttcccaattctggaggctagacgtctgagatcaaggtgctggcagggttggtttcttctcaggcctctctccttggcatgtagatggccgtcttctccttcctgtgtcctcacatggttttccttctctgtatatctctgtctttatctcctcttctttttattttatttttgcaattctcctgcctcagtctcctgagtagctgggattgcaggtgcccaccaccatgcccggctaatttttgtgtttttagtagagacgggttttcaccatgttggccaggctggtctcaaactcctgacctcaaatgatctgcccgcctcggcctcccaaagtgctaggattacaggcatgagcccccgcaccgggcttatctcctcttcttataaggacaccaggcatgttggattagaactctaatgatgtcattttaatttaactacctaactagacactaatgatgtcatttttaatttaactacctttttaaagatcttgtctccagtgtagtcacgttctgaggtactaggggttgggacttcaccgtatgaattttgaggggacacagttcagcccataacacctgctttcttctctaaaagttatcttttaagaattcccacttgtcgataacaattctttgacaatagttctgatgactacataatatcccatcattaaaatataccacaatttacttaatcaatttcatattcttggacctttcaggtgttttcattttttcactaatataaatgcttccataagtagttttgtacatggatgtttggatatctgactatttgtttggaatagattgcttgaagagtgattattgggtcaaaaggtatgactattctctggtttttaattacatactgcaaaattgttttccagaaaattgtactaatttacattcataccaggaaggagaatagtcagttaggcattcatataagctgctggtgggaatgagaaaggaaaaataaactctcatggttgtttcactttacattaattgatgactaacaaaatggaatatttcatgtatttattaatctgtttgcatttccttttttgtgaactgttactcatgttctttgcccatttatgtatgtgagtctatcattttaggtgataagattatgatttagagtgagttctactctaaagagggaaatttcagaaaaagtgaaattccaaagaatgttatggatccagaatccaaggactattggtctgagtctcttctttggagaagacttggcatgtgatgacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagtttatactggacagaatccctatgagtgtactgactgtgggaaaggcctcaagacaaactcagactgttttttttaacatgagagaattcatagtggagaacaaccctatgctcataatgcatgtggaaaggctttcagatccagctcagactttactaaacatgagagaattcatagtggaaagtaaccttatgcaatgatgaatgtgggaaagggtatctggagataacagaccttcaaaaacattagaaaatttatagcggagatggaaagagatcctttcagtgtaatgaatatggaaatgtttttaatctagagctcaaattttatttgtcatcaaagataatcttttacaatgaatatacaaaaacctccaaacagaaatcaatccttgttcatcatctgcagattcatagtggacagacactctgtacctgtaatgaataagccttcaattagaggctaagtcttattcattatcagaggattcataaaggcatcaccttctatgtacgtaaaaaattatgggtatgctttcagcaggatatcagccttatttgatattggcaagtctatagcgagttcgcttaaatgcagtgagtgtggaaaggccttcaatctgaagtttaatcttactcagcatcagaaaatacagagtggcaggaatcttattaatgtaatgtgtgtgggaaagtctttatgagaaaatcacgtcttggtaaaaatgaaaaaaagattctttgtaaaagttaaaatagttaccacataattacacgcctgccagtgtgccaagcactacaagaactttacattgtttaatcatttttttacaataatcatacaatgtagaaatcctcgttgttttacacacacatgaagaaaccaaagaaatgaggtggaaaaacttccccaagatcacatactagtcactggaagagccagggtttgagtcctagagagtttaattgttctgggtttatagtggcaatatgtaaatcttcaaggatgtgttagtctttattcattattaagaaattccttcagaaatcaggattcactcttcagtgagtattgggagccttcagtcagttttggaattagagactctacattgggttctatcaaatttagtaaggactataaagactttatcatatttatattatccctttgaatagggattacttccaatcttgaaagatttcattaataacaaaattctgttctcaaatgctcaccctaaccactttctgtggtgtagacaacgtggagtgggatggaaagcacaggctctgggattggccaggatagcttcaccatcaggaacaaggtagagttacccagttcttaaaaagattgagtaggaatggagaggacagatgtggtgagagcttcaggaacagagtcaggtcattctaggaattataaccaaacaagccaaaataaagtagaattcagcctataaggaagtggagaagctagggtatgtggcatgattttctccccagatggatttagctataggttgcttgtgtatcacccagtattcagaggaacttgaatttgaaattgcttcaggaatatgcagtactctagcactgagtcaaaaataagcgtgactttcagaaactcaaggtataagaaatattaataaattgattttctaccttctcacttcaaggaggcagtgtgctacaccagaaagtattcaggatctaccttcaggtataactgggtttatttgccagcttaaccaccttctagctgtgtgactttagttatattaataaatctctttgagtctcaccttgctcattttttttttaggtcaggatataatactgtaccaagttgtaaggattctagataaagggtataaagtgtctagtatggcgcctggcatgtagtacatacctaataaatatgttattgaaatatattattgttggttctgcaaggatcttaacactctataatagacctctccaaccccagttggggaatgaatgtgttacacttgtgttgtgatagtattaatcactttagattatggggcttctgctggcttatatggtacctttgtgtgaattgtaaaataatacctcttcctcaaaagactttcttaccacttgctagaaaattgtcataataaacacagatatctttgatggtcataatgtgaatggtattctgcagaatcatgcggcccacaatttgcaaaacctgaagttggtaggctgaataaatggccccccaaaactgtctgcattttaatctctagaacctgtgaatatatattacctgaaatggtaaaagggacttcggcagatgtgatcaaattaaggattttgagatgcagggataatactggattattagggtgggcccaatgtaatcacaaggatccttataagagagaggcaggaggaccagacttatagagagagaatgtgaggactaaaggagaggtcagagagggaagaagatgctatgctgctggctttgaatttggagaaaggagccatgaacaaagaactgcctgggaggcagaggttgcagtgagctgagatcatgcaactgcactccaacctgggcaacagagtgagattctgtctcaaaaaagaaagaaagaaagaaagatcctgtgggtaggagtgtgatggatagccgggtgcattggctcacatctgtaatcccagcactttggaaggccgaggcgggcagatcatttgaggtcaggagttccagaccatcctggccaacactgtgaaaccctgtctctactacaaatacaaaattagccaggcatggtggtgcacatctgtagtcccagctacttgggaggctgaggcaggagaatcgcttgaacctgggagggggaggttgcagtgagctgagatcacgccactgcactccagcctgagtgacagagtgagactccgtctcaaaaagaaaagaaaaaaaggagtgtgatggatagattggaaaagagaactgggtgcagggagaccagttaggaggctatttataaagtagatactgaaatctgggttaaggcagtgggaatgaaatgagaataccatatatgcaataaatttggaacttggtcactgactagatatagggggactgacggagaagaaggaatcaaggatgatgcccagttgtctttctgccttggatggttaacaagttgcaaaaaccattcatggagaactcagaataaggagcaggtttgtggggaaagaatgacctttgcagtgtccaagaggaattattcagtaggtagtccggaattcattctgctgctgtgaagcaagtagggttacagatagaaatcagatagaaatttggtagtcatcaaatacagaagtggtggttttaattgaagtatcaatgagattgccccgggagagggtggtgtggagtgagaaaaaaaaaagacccaaggcagaatctcagaaacctaggcattttgagggaagacaaagctgagaatcagcagaagaaaggtaggagggggaccagaggagatacagcattcttgttctgccctcttgtggcaagctgagtgtgtcccagcataaatcttccctctcttgtcttcagtcttccaggtctctgactcataattccattcccaccctacctgggagaatggagctgccaggtcttctcatggtcatttctcaaatgtaaagctcctcttcgattatttctacaattcaagagcaatttggaccccacccccatgttgcaaaagaataaaaagcaaacagtggggcggggcttcagtttccacatttatatgctccaccatcttttgatctattctattggcctcattaattttagtacatctcaactctcatcatatcccttcgctccctttataattaaaagacattttattttgaatttttttattatagtaaatatactgtatattatagcaagacctatgtatggcttaaaaaagaaataacaaaaaatagcagtattagcttcactttttttcaccaccagacttgaacacttgaaggctagaatgcaaattagccaactttgaaatctacttcttttggtttttatctaaataccattatttcatgagttacctatttcagatattagctgttgacttcccattatggtagatgaagatttaattcactttttctccctcaattaccttctctattcttttagtatagctatagcatactttctggttaatgatgtttatactattgtgattgtgcaaacattgttcactaaagagacaggtagtgaattgtgtctatgtttctgttttgaacacatttgtatcatttctagagttataattcccttttatctgtgtatttttatatatttatatttgaggcagagtcttgccctgtcacccaggctatagtgcaatagtgcgatcttggctcactgcaacctctgcctcctgggttcaagcaattttcctgcctcagcctccaggcagctgggattacaggcgcccaccatatctggctaatttttttgtatttttagtagagatgggggttcaccatgttggccaggctggtttcgaactcctgacctcaagtgatctgctcgccttggcctcccaaaatatccttattttttctgttagctctatcatatgtctatttttgtgtaactgctaaaaaacgtcagagtattcagaatatttattttctagaaatcccctttgtagagccttctctcttgatccagtctgggctgttttcaatcctgaaagcttttgggatttccactttatccctaatattctaaactttcatgatgatgtgtggatatttgtatatctgttgtcctagatacctggtaggtagactctttcagtttgtatgtttttgtacttggactctggaaagttttattatttcttggatactttgtgagctccataaggacacatttttatctattttatttatttctgtttttccagtgcctaaaatagtgcctgatacatgatagacatttatttgttgaatgaattactatttacatttaaaataataaaaatgaaataatgcctccagacccaccgaccaggacaagaaatagaacattatcagtactttagtgccctatccaatcacaccttcctgtccgcctccacctagagataatactaccctgatttttgtattaacaatttctttggttttcgtatatttttatcacttgtatatatgtttttaaacaacatattgtttagttttgaaaaaatggaaaagcgaacacaaacctagttgtacgagaaaagggtactgttgcccctgttagatagtctcccaggaaaacagaggttctgcgtcaaaaactgattttagcttctctgagaactgtaaagccatttctgggataattagtgaatgaggtcatgaaatttactgttactgatgaaagtcctatctgtctaatttaatttttctattgcaggtgacattttctctcttttcagctctcagagttatagttgacaaaaattatacgtattcaaggtgtatacatattcaaagtgatattttgatataaatatacattgggaaatgatttctacagtcaagctaattaacatatccatcaactcacagttaccttttttgtgggaatacttaagatctactctcttaatgaatttcaagtatgtaatacattattactaactatattcaccatgctgtacattagatctccagaacttactcatcttacaaccacaagtttgtatcctttgaccatctctccacttcccccacacactggctgaccttgggtaaccacccatccactctctgtttctatgagttcaactttttaaagattcagcatataagtgagatgatgcagtatttgtctttccgtgtttggcttatatcacttagcatagtgtcctccaggttcatctgtgttgttgcaaatggcaggatttcctttatcaagggtgaacaatattccattgtgtgtgtgtatgtatgtgtgtgtgtgtatacacacaatttcttaatgcatctgttgcagacacttagattgttttcatattgtaactattgctaaaaatgcagcaatgaacaggggagttcagatgcttctttaagatagtgattttatctcctttggatatacacccagaagtggaattgctggatcatatgttcaattcttaattttgggggggaacctccatactgtttctgctagtgactgtaccactttatactctcaccaacaatgtataaaggttcactttttgccactttttgccaacacttgttatcatttgactttttgataataactatcataacaagtgtgagatgttatctcattgtggttttaatttgcatttccttgaagattagaaatgtttaacactttcaatatacctgttgggcatttgtatgtcttccttggaaaaaatgtctattcaggtcctttgcccatttttaaattgggttatttgtgtgtgtttttttttaactactgagttaactatgtgagttccttatatattttgtatattaaccccttatcagatatatggtttgtgtatattttctcctaatctgtgggttgccttttcattttgttgattgtttcccttgctgtgtagaaactttgtagtttgatgtagtcccacttgtttatgtttgcttttgttacctgcctttttggtgtaataacaaaaaaatcattgtcatgttcaatgtgaaggaccttttccgatgttttcttctagaagttgtatgttttaggacttgcatttaaatctctaatccaatttccaatttgagttgaggggtgtgagagagagagagagagagtgtgtgtgtgtgtgtgtgtgtgtgtaagataatgatccaatttcatttttttctgcaatggacattcagtttttccaacaccatttgttgaagaaactatcctttccacattatgtattcttgatgcctttgtcaaagattagttgactgtatatgcatggatttgtttctgggctattttatttatttgtctatgtgtctgtttttatgccagtaccatgttgttttgattactatagctttgtaacgtaatgtgaaatcaggaagtatgatgcctctgactttgttcttcttattcaagattgcttttagttattaataggggttttattgaatctgcagattgctttagttagtacggacattttgacaatattgattcttccaatccatgaacacagaatacttttcaatttatttgtgtctttttcaatttcttccattattgttttgtagttttcagtgtacagatcttttacctccttggttaaatttattcctaagtattttattggttttgatgttattataaatgggattattttcttaatttcccttttggattatttattgttagtacatagaaatattattgatttttctatgctgatagtatattatgtaacttaattcatttattagttctaatagtttgttttatggagtccttaggtttttctgtatatacgattatgtcatctgcaaacagatataatttcacttcttcctttccaatttggatgcattttatttccttttcttgactaattgctctggttagggcctccagtactatgatgaatagaaatggtgagagtgggcatccttgtcttgttcatgatcttagaggaaaagcttacaacttttcaacattgagtatgttgttagccatgggcttgtgatatacggcctttactgcctttgggtacattcctcttatacctaatttgttgagagtttttatcattgaagatttctaaattttgtttctctttctctttaagattgtaattttttttcttgtttccttgaattcaagaatttaatcagggtatcctgagtatatcttagaatgtaagctccacaaagacagggatttttgtctgttttgttcactgatatatcccaagtgcctagaataatgctggctatgtaataagtcctcattagatgagttgattaaattaatgtatgaatgcataaattgatgaatggatggatgaacaggtactcaatcttgtctggaattcaggtagccctttctttagctcagggaaattttcttctatcatttagttaaatattgcctttcttccttctatttcttttctcctttaactccccatccatctcccatattcacattttaggttcattgacactatcctctagataccttgtcttgtatctcattgtatctattgctttttgggtttttttgctcagtgccttgatataaatcttgcacttaattttctagtcaagtaattcagggctcatcattgacatcatttttcattttattgtttaattggaatttgatacagtttggatttgtgtccccacctaaatctcatgttgaattgtgatccctaatttgggagagaggcctggtgggaggtaattggatcaagagggcagatttcccccttgctgttctcatgatagtgagttctcacgagatctggttgtttaaaagtgtgtagcacctccacccttctctctcttcctcctgctctggccatgtaagatgtgcctgcttcactttcaccttctgccatgattgtgagtttcctgaggcctccccagccaagcttcctatacagcctgtggaaccataaactaattaaacctcttttctttataaattatgcagtctcaggaatttccttatagcagtgtgagaacagactaatatagaatttgtttttaaagctttgagctctagaaagtttttgtgtgtatatgctgcattttcctcaggtgttcttattactttttagtcagtttttacatatcttgtctaatagctttgttttatttctctctgactgctgaaactttttaatgtttgtttttatgaatgatcactttgtgggccttgatgtagattggaatgtatttgagtcagtactgctagaatatcaactatgtgcagatatgaatggtgttactatggaaacgaggtcacatgtgagttctgatcttcacactgccttatttccagcgaaaagttgccatttctttagaacactgattgtccccggataaaactgtgaacattccaatatttaggcctagtcaccttggacacaaattgcactctgaaatattgttctttcactgagagcagacaagcacagtatttaagtttatatgcaaggtctcaaaagctaacacaaagctagctagcaaaaagaaaaaagaaagagctaaaatgactgttagatgtaattctacataacctgtttttaacaagagcattctataagactaaattctaaattttttcatcaaagggtgtttttctactcctgattaattttcacctactgtaccatggtaactctacccattcagaatttgaattcctagttcagggaaaggaggaatctggggtagtggcaatgcaatatccttgtttagacttgatgttaatttgtatcagtgtttgctggtaatgctaatcaaaaacaaactccacctagaaacctgttagtggtaaaacatggataacaccagtaaagagaatttatatgatttcattgatccattgtgtggagctgtgagggatcaataaataacattcatctttcctgactaggttcagaaccaattgaaattgaaagatgtaggaatccgataaatggaactcaaaacatcatctttattactgataacacttcagagaatatggctttaatgtggacttcctaatattggaccccagaattaagcagatttacctaaaccaccataagcaatggtgaaaaaccacaagactctgggccaaaagtgggccacttgatgcatgatatgttttctgtaagcatgtagatgaagggcagagagcaagagcctaagccaagctgtattagtcagggttctctagagggacagaactatatatacacataaaaataaaggggagcttattaagtattaacttacacgatcacaaggtctcacaataggctatcggcaagctgaggagcaagaagagccaatccgagtcccaaaactgaagaacttggagtctgatgttcaagggcaggaagcatccagcacgagagaaagatgtaggctgggaggctaggtcagtctctccttctcacgtttttctgcctgctttatattcgctggcagctgattagattgtgcccaccagttgaagggtatatctgccttccccagcccgctgactcaaatgttaatctcttttggcaacaccctcacagacacacccaggatcaatactttgtatccttcaattcaatcaagttgatactcagtattaaccatcacacaagcatactcagatgtttcttccaaacatactagtcacataactcattccttcttctgtggacagaaaagcaggagtgttagtctatttgaagttcttccacttagaaacatgagaagtaaagattaagtgttccctctaacatagctcagtgatgtattcagtattgccatgtgcttgaacttgtctatctcttcaggaccaaaaatatcataattttgctgtgacacgaaaggtattaggatattttaggaagactgtagtacaaatagctcaattacagaatatcatgttaatgacatatcaatagaatatttaaaactccatctaaatgctataacaaaacatgaagaaatgcttcttaaaggcagatgtaccaaaaggaatccattcaccactctctaccaatgggaacatcaaacattgtacctttagagcatggtatatttctccacttaacacctactagaactctgcagtgaggcttcaagtgagaaacttctctgttatatctgggttgatgtaagatccacatatcaggaaagtaagtgtgtgtgtgtgtttgtgtgtgtgtgtgtatgagagaataagataggagtgggggacaagaagggagaggagaggaaataaaagaaggaaaatgagatatcagggaatgagcaccacaagtgtaaaatcctaagtgatgtgggtcatgtgtttgatggagagatagggagagagtattgtgtggtagtggggtagtggaggtatgtggccaaggtatgtgtgataatggtgtcaatggggacagtgtaaggatggtatgaaatcactgtgatcatgaagacagaggcaatgtgagtgacagtaacaggaagagatcagaatgtatgtgacagttgtagttatggtcacagtgtatgtgaaagacaagaattgtgcatgtgtgtgaatatggttgtgtgagaaagtggggagggagaggacaggataatgggacactgggatcattgtgtgtgtgaaaatgtggatgggacatgttgatgtagagggaggttggaatggggcaggtgtaatgtcattatggaagataggtacatgatggaagtgagaaggctggtgtatgtctgtgtgtctatgtgtgctggggaaaatgagaagtgtgtctctttgtgaggacagatggatacagtgagcatgggtaatcacagtcaatgaaaatgtgataatttggagtgggaaaatcatgagtgtctgaatagggttgttgaataaagtatatgatgggaaaatgcaaagagtttctgagtgccagtgaggaatggggaatatatgtgagtgagagcagagttgatgtggttattggttgtgagtatgtatgaaatggaggtggtatgagaatgtgtggaaggagatttggaggatgatacaagtttgataatggagatgtggactgtgtgtatgatagtgggtgtggctagacactgcgtaatggtgtagtgtagggattgagtaattggggtgtgactatatgaatgatggggatggtgtgtatgataatggggattgatttaagttagtggtatttgacagtgggtgtcgtgggtaccatatctgttctggtctaaagacattttatttatgatagtacaggataggacagagtatgtgtggaaatgggagtgatagagacagtgtacatgttagtgggcatattaatccattttcacactgctataaagagatacctgagactggacaatttattaaaaagaaagagggtttagggtgctggtattgcaggtgtgaaccactgcccttggcctggaagatctccatttttatgattttttttcatttttaatttttttttaagagacagggtatccgccgggtgcggtggcttatgcctgtgattccagcagtttgggaggccgaggcaggcgaatcgcttgagctcaggagtttgagatcagcctgggcaacatggtaaaaccctgtctctacaaaaataatgcaaaaattagaccggtgtggtggcgggtacctgtggtcccagtgcctgggaggctgaggcgggagaattgcttgaacccaggaggcggagattgcagtgagccgagatcgtgccactgaactccagcctgggtgacagagtgagaccctgtctcaaaatgaaacaaaacaaaaagagacggagtcttgccctggcgcccaggctggggtgcagtggtgctatcatagctcactgcagcctaaactcctggggtcaggggatccttctgcctcagcctcctgagtagctgagactaggagggtgagccaccgtgctgggctaggatctccatttttagacactttatctcagtgtattcaaaatatggttcttggacaagtgtgggttggtgatctggtctgccatgaactgagcctaagtgtttggcaaattttactgcaattttagagtgattttatttatgttgaatcaataatttaaaaagtgaggcttgtattttgtattctataatttactgtaatatcattttttctagaaacagactcttatttcacaaaagtattggttgaaacgaattaaagtgaacaaaaaaccaactggttttgcacaagtagtttgaaatatattgctctatcttactcaaaattgatgcgtatgtgatttctttttctataatgtgaagttttttttgttgttgttctttggggatcttgtgctctactcctaaaatattaatgtcatgcaggattccagaattgttttgttttgttccagatatttgccttgcgtatataaagatgtggtcattctttgcatgctctttccccagagacacatgtaaatggagttgtaatttcctgttggtaaacagcaagtatttaaatttagaatcaggtggtaaggttgatatgtagaagggtaatacattggattgccttcaaagtgatatcttttccagttaactgttaactcactaatttactgtttttcttttctttcttatgcttcatgaatttatgtgtcatctgtacaggggccatgtgctaatctctgcacggttccaattttagtgtttgtgctgccaaagcaagcacggcttttcttaatcctatcaaatattacatggtatgttaaaacagtatagatctggcttaaggtatttcatggatgacaaatggacctcatgttatagaggaatgaaagatataaattaataaaacatgatcatgataagaataaaaccaaactaaatctcctctccagtgcttggcagcacactcccggagagggttcaggctgtatgtggccccccagcaggtgctcagagatggcttaatggcctcggtgacaacaggagcccagactgcataagactctgcctctgcagatgcagaacagtaggggcctctgatgtgcttgaacatctgttttggatctccatttctcctcaagaagagactcctttttaaaaattattttttttgaagctgcattacttactgatttccagagtcgttttacacctgcccttctcaagggaatattttgggcataatcttttttttttttttaattatactaagttatagggtacatgtgcacaacgtgcaggtttgttacttatgtatacatgtgccatgttggtgtgctgcacccattaactcgtcatttacattaggtatatctcctaatgctatccctccccccttcccccaccccacaacaggccctggtgtgtgatgttccccttcctgtgtccaagtgttctcattgttcagttcccacctatgagtgagaatatgcggtgtttggttttttgtccttgcaatagtttgctgagaatgatggtgtccagcttcatccatgtccctacaaaggacatgaactcatcattttttatggctgcatagtattccatggtgtatatgtgccacattgtcttaatccagtctatcattgatggacatttgggttggttccaagtctttgctattgtgaatagtgccacaataaacatacatgtgcatgtgtctttatagcagcatgatttatggaatcctttgagtatatacctagtaatgggatggctgggtcaaatggtatttctagttctagatccctgaggaatcgccacaccgacttctacagtggttgaactagtttccagtgccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcatttttttaatgtgttttttggctgcataaatgtcttcctttgaaaagtgtctgttcatatccttcgcccactttttgatggggttgtttgtttttttcttgtaaatttgtttgagttcattgtagattctggatattagccctttgtcagatgagtaggttgcaaaaattttctcccattctgtaggttgcctgttcactctggtggtagtttcttttgctgtgcagaagctctttagtttaattagatcccatttgtcaattttggcttttgttgccattgcttttggtgttttagacatgaagtccttgttgggcataatcttttaatctttctggaaagctaacaaaacattatctatgccaggctttccaccaggcacaccccattctttccatcacagtgctttttaaaggactttatcatttgttctctgggttcatttaactcttaacttacaccgatttagcatctttgctatatttcctttcttatttcattctttatatgttatgttacatttctgtttgagtctttacagtatcttctttcttaccaacttgtctttctagaatattttcacaattaatgttttggtttgctttgaggtaggcgatcagcaggacttgttttctgagcactggtcaggaccctgtctatctaaatgatatgtagcaaagaaactggccaaagccatgtaggaccagcaattataatgcacttgcgtaagacacttctaccactaccatgacagtttacaaatgccatggcaatgacctggaagttaccttatataattctgggaactctcttccctttttccataaagtttgtgaataacccatcccttatttagcaaataattaagaatgggtataaatataggtagccagcaatccacaagtgctactctggaccaatctgcctctggggtggccctgctctgtctatggagcagtcacttggctgtacactgttgctcaaataaacttgctttctttcattgtcaaaaaaaaaaaaataaataaaaaaataaaaagaaagagggtttaattgactcacagttctgcatggcttgggagggctcaggaaacttacaatcttggtggaaggggaagaggcacatcttgcatggcagcaggtgaaagagagtgagcaagagtagggaaaactgccttataaaaccatcagatctcatgagcactcactatcatgagaacagggtaagggaaaatgactccatgatccagtcacctcccaccgggtccctcccttgacatgtggggattatgaggattacaatttgagatgggatttgggtggggacacagagccaaaccatatcagcaggattgaaaggtaaagtgtgaatatgatagtttggagaactgggacaatatgtggagataatacttataagtcatagtcatgatcatgagtcagagagagtcatgtgaatgagatagtgtgttagactgtgtgtgtgtgtgtgtgtgtgagagagagagagagagagagagagaagttggggtaggggcatgtcatgttttaggatgggtatttggaatatcatttggatatgagtaacaaggacctaaaaatgagttgcttaaaataattaggggatatcttttccttacctgaaacaagcccaggacctccacaattttatcaatgtctcagtccccttatatatttttttgttccttggtccttggtatatagctctcatcttccaggtaccttctggttgaaggatgcctgctgcaactctggccatcatttctatgtttcaggtagaaagaatgaggaagaggagagggcaaaaataccttgtcagtggaattagtctccttatacagagctttcccaaaaatcctatccagttactgccaaatacatctcatgggaaagaactgtgacacatagccaccactatctgtagctgagagaacatggtaagaaaaaacagtttcttagtaaggaaaaggagatgttggtaggatatcaccagtagagaaggagaggttgaagatttgcgagagggagtataattaatagatgaaaatcacgatggtgctagatacagatgggatatgactggcagagtttgagatgctggaggatatcatggtaagcaaaaatagacatattgtctctgccctcatgaagctactgtcttgtgaagaagacagtaatcgcagactcaaatatttgtgaagttgtcactctggtaagtgctatggaggggaagtacatggttctgtgaataggttaaaagagggctttacctaatcagggaagtaaaagcagggaggaagtaatgatggagatgaaaccagaagacagattcagaattgattggttgaaggatctgtggatgggatggggtaaaagtgtttccagaagaggaaacagcatgaacaaagggacttatgctctgttgtcttttaaaatgtattttatttcacttagaatcttttccattatgtcttcaagttcactaatctttagtaattaatatcatctagcatttttttcttctcaaatattacagtttttatatctagatatatgacttggaccttattaaatagatctcatgtttttacttaacatgaccattctttcctctaagtttttggacacatggaaatagttataatggcttttaatgtgcttatctgctaattataacatctattaaatatttaagttctgggtaagtttggattgattgatttttctcctcaagatgggtcctatttttctgcttcttggtatgcctggtttttttttaattcgatgccaggcaatgtaaattttacctttcggtaaaattttggtgaaattttttcttttggtgctagatatttttatattcctacaaagctacctgagctttgttctgaaatgcacttctttggaaacagttagatctttttgagtcttgcttttatgatttgttaggcaggaccacagcagttttttgcataaagctaattatccctgactgatgaggcaagacccctctgagtatcccatgccaatgaattaggaagttttccactttagctggtgagaacagcatggtccccagacctgttggagcttctggcacttgttccctttaatcctttcaggtgactctttccccagcctcaggcaatttccttttatgaattcactgatcagtactctgtcaaatacttaatggcaatccttcaaagatctccagtgttctccctgtgtaactctctctttttgggtactctgctctgtgaactctagctaccttggtctttctggtctctcatctctgtcactccaattcaaggaatcccctggattctgactacattctcccttgttgctccacaaactggaacctctcaagcagtaagtgctcacttcttttttcctcatctctcagggattactcttcttcattgcctaatgttcagtgtcttcaaaaaccattatttcatattttatgtccatttttaagtgttttttgtcaggttggagggcaaaatcctgtctccagcttgcctcttaggaagttatatggtggagacctgttagataattattttcttttcttttacagttgtttgaccttctcactactgccaagtatcacaaatgagtgacagttataatttttttatcaaatgagaaaagcctgagaataagaaatgtattcaaaatcagggatttgaggaacaatttgggtcacaggggaatgtggccatatattacaaggataactcctcatgactctaaccacaaggaacttctgagcataaagacaagttagaaaaggagattaaccttctttcaaaggatagatgtttaaggcttggggtagatattcacaggattggttcccagccagggggcttccaagactatagtaagtgttagagtaattgtgctctaatctcagacatcctacgggaggatgaaaccatacataggacaaacccacacccacacccatagtgtgggtcacatgaccatagcttcagaccaatttcagagactataaatcagcacgaaaaggccatgatggtgagaaaatgtgtgaagagcattgaagagcctttggccaagcttcagatcttattaacatcaaataattcattagcagagataaactctatgaatgtagtgatcatggatggtctttctttctttttttttttttcttttcacattcagttgactttgtggatggtctttcaaccagagttcaaatgtcattcattattgttaaacacatactgaagccatagaaatgcagtcagtggaaaaaagccttcaggaacaaatcaaacctgagtaatcatgagaaatttcaacctggagagaaactgttgaatatacaaaatgtgatactccactctgttcttatcccatgcagactcccccaatctgtgtaagtgattcctttggatccctcctcacatggctttggtgagggagttgcatgcccctctccttcctcaagaaaaaggaaaacactcttccccaagccaaggactcacaacactgtaaattcttatctaattctttctagctttctgagtacatatgggctgaaaaggaatggaatgaataccagtagcatgactagtatgctctccccatgtaaggcccgtaggattgtgttcagatctcctgggatgttctttttagaatgtggaggcactgggtacctttttcttttcttttcttttcttttctttttaaaggctatatggctttaaccaaaattctgaggaaagtgtgaaagttccattcaataacctgctaaatttatattatcttttctcatttaatattacaatagaagcatgcttctgccattaaaaacatctgaatcggattttttatcactttcaatttaaagcatagtcttcaaaggtaaattactaagaaagtatagatattttttaggctctaaatatacgtttctgaattgttttctagtaaaaggaatatttgtttggcttttcaatagcaaaggacatcctcagcattttttttaatggagaaaatgatagtggaaaagaaagtcatagattgcattttttcctagatcaggaattcataaataagactaagaggcaagacaccaaccaaaaaaagcatttgcaacaagtgtgacagatacaaggttaataaccttaatgtacaaagaattctcacagcaaaatacaaatgattaagaaacgctgagagtatcttcccatcattaataataataataaatacagtttgaatcaattaaatgtcattttgtctgtcaaaatggcaaagatattttcaaagcaaatgttcagcactgttaagggtatgtgagaagtcttctgcattgctagtgttgacaaaaacctttctagaaagcaatttggtattattgaataacggccttaaaatagttcatacccgtttgaactagtaattccatttctaataatataccataaagaaataattggaggtatgcacagaggtttgttgggggaaaatcaccacaatgataatctagtgaacaaaaataaatggaaacaagatttttgttatttggtcaagtaggtaagttcatatgatgggatattacacgttatcataaagaattttgcaaagactttttaatgtcatagaaaatgttatgccaagataattgtgataaaacattatatacaaaaagaatctcagatgtagtatattaattacaactgtgcatgtatgtgtgtgatgttagacttggtatggaccattttcccaatgtttttcagatgatttttcttttataaaatgaaatcaggaaatgtcatactatgtagctgaactcatatgacttttctgagtccagctatatatctattttaattgttgttaatgttccatgattcccaaattaagtggtttatgaggtttatattgatgctgaacattgaggacacatatggcactaaatcatatcccaggtgtctgagagcattcagatatgtcttgaaattttccagtgcaaatcaaagagggactctatgtcacaagataccagaagctcacatggtaaggtcatctgatgcagtatcaaacaaatatccccaaactgtgcattgaggttctacttgcaggcttcctccccttgtctcttctgataaccttctgcttattaatggaatgtgagttgctgtggtgatgggggtgaggaattaactggaagggaattgtgcaatatgaaggaaggtgtaatctatttaagtctgtaagagattacaagtcaccaagaaagcctgcgatggtgagaaaatgtgtgaagagcattgaagagcctttagccaagcttcagatcttattaacatcaaaattcattagcagtgatgaactctatgaatgtagtaatcatggatggtcgttcaagcagagtttggatgttattcattattgttaaatacatactgaagccataggaacgcatttgatataatcctaagatgtcactttgcctgctcttatgatgcaaattggcaccagaaatccagccaactttattaaaattgtggaaatctgactggactcagatccattaatccttgaaagcaggtaatacatgtatttttgccatcattatttctccagcacttatcacaatgtgtagcactttactaggtatacttttaaaatgttttaaaattcttatacatatataaataaagaagataaaatcaagttgactcaagtctagaaaacatggatgagggatttaagaattctaaagtgtttattctgaggcaccatattgctttatgtttggaggctcagtgtatattatcaatgtagaggcttcaagagggacccattatttcatatggttattctatcctttacttaggggtgttataatctcatgctatgattttgtttttattatattttgctttaaagtactatgtctgatattaatacatcatctttttattatttgcatgtaataacttattccatccatttattttcatctttgctgtatctttatgtttaagatatttctcttgttaattgcatgtagctgcctttataatggaaagatacataaatttcctttaattacagcatcctcaaatattctgtaattggagatttgatttcctctttgaaggaaagcttcatttattccttctccagtgctctccctttctttatgtacttccaagtttctgccctatatcattttctttctgcccgaagaaaatcttctaatatttcttgcagggcaggtctgttggtgatcaattcattctgtttttgttcatctgagaatgtctttatttctcctttactttttttttcttctcctttacttttgaaagatcttttcctatatgtagaaatctagggtggtagtcatttttcttttaacactttaaatatttcactttactcttgttgcttgcatggtttctgatgaaagctgctagaattattattcttattctattataagtaagatatttggtgttctctgagcttcctggatctgtaatttggtgtctgtcattaattttggaaaattcttagccattattacttgatatttcttctgctgtattctctttctcttctccatctgatgttccagttatgcatatgtgactccagatttgcctatccatcaagattttagggtgatgatttgccctgaaatttcatttctctgacaggtccaaaaaagtgattgatttttagtttgtccaggttttttttctggttgttggtgcctccagcctcacattgattctgtggtggaagaaaagcatggggaagcaaagagtcagtagatattgtgggttccttaaaaaggaggaaccataagccccatattttagggatgggaagaaatgccaggtaggtttgcaagatccttaagcaatgtgttcttttgtctcaccttctggctaaggccagagaggacaagactacaaaatagaattgtctgcgtggtgtctataattatttggagcctcttcatgtggtttccctcagctcagggtatttacaggagtatatgtgagacaaagacagcctcacggaggttaatagacctcagcatatcataggaacagtagaatgttttccatgtatatgagtgatatatgatacccaaagagatagttggacccaaagcagctttacagtaaagaaggaagctcactcaacagctacctgcttggacagacattgatgaacaaatatgacatgtatgccagcatggatacatgatacccaacatatgttacccatcctgatgttttgacactatttaacatccctagaacttaaatacaaccccaaagcagagagtgagagggggactccatactgctggagattaagtttccaccactcagtagaatgggaacttgacatataatttatgttgagttgcagagaaaataacttacatttcctgcataccggagtttgtcagataatacccatacctgcagaataatcattaacagaaagtgggtgataaacactgagtatctcaaacaaatttatctactcaaaacatggggtatgtggctcttatagtagaaaaccacggtggtcttatctcaaggccagagtgagatgtgagaaatgacctctggcattttggtgggtaccaacataaagagaacagggaatctgaggagagcaaaggacaacttctctgcagaacgaaatcactgtcattggtgaggtgtgattctacttcatttcttcatcttcctgtccctgtccctcttacttcaaatacttctcttttctccctggttatttcctctactccctccttcctcttttttatccctctccttgtttatttttcatccctccttatctattccttaacctcttgtcttagtcagttcgggctgctgtaactgactaccatagactgggtggcttaaacaatagaaatatacttctcaccattctggaggctgggaagtccaagacaaaggcactggcagatctgctgtctgttgagggccctctttttcctggtttgcagatagccatcttctcgttgtgtcctcacaaggtggagagcagaccgaggaagcaagctttctcccttctcttcttataaggtcattaatctcattatgagggctctacccatatgaccttattacctcccaaagtccccatctccaatacagtcacactgaggatttaggtttcaacatctgaatttggtggggccacaaacattttgtccataccacccctctatctactcctgcctccctctcatgctcttccaccttacatcctcttctctttcctcttgctttttctttttcttttcttttctttttttttttgagatggagtttcgctctcgttgcccaggctggagtgcaatggtaagatcttggctcactgcaacctccgcctcctgggtagaagcgatattcctgcctcagcctcctgagtagctgggattacaggcacttgccaccatgaccagctaattttttgtattttcagtagagacggggtttcaccatgttggccaggctggtctcgaactcctgacctcaggtgatctacctgcctcagcctcccaaagtgctgggattacaggcatgaaccattgcacctggcctcctcttgctttttctacttcaacttagtatctgttctttctccattatcttatttttccttatcttcctaattccatttacttccagctgctattttcattcatcttttcttattcctattatattctttcttcttttcttcttccctctcttcctcctcaattcctttctttcctacttgaccttctttctcatttctcccactcttcatgctcccatctaacaagatagtggaaaagagagaaaaaggtaatagaatgcaataaaaatgtacttaaaatggtaacaggaataggtgatgggtttgactggggaataaggcagagagaggcattatgaataacccaaagtaaaatagggagaaaaagaggctattaaatatgattttttaaaactacttatcaaaaagccataattattctgataggcaaaatggtaaagtcacttcaggaaaaagaaagggatgttacttatttagattattactcagtattgctcttgatgttttagcaactcagagaagaccaccaaataagtgctattcatattgtaaaagaagtgatcaaattatttctttttcttatagtgtgattgtacattaagaaatcacaatagatttttaaaaaaataaaatactagaattgaggacttctacttccagaaagaagtagtaaacagggtagatgtattttccctattcatctctggaaaaaatatataaacaaaacataagaagacccagaaagttgaaaagaagatgatgtattctctagggaacttggaaccaaggaatcaacatggaggtaagttccctgtgttttctttttgctgcatacatcctagaccagatgctagagaaactggcaaactggaaacaccaaagggcacagacaaaaaaaaaaaaaaaagcttcaatgtaaatccactctttcttcacctaaagaacagacagcttagtaaggcaattattttttacttttatttttttttgagacggagtctcactcttgttgtccaggctggagtgcagtggtgcgatcttggctcactgcaacctccgcctcccgggttcaagcgattctcctgcctcagcctcctgagtagctggaattacaggcacgtgccaccacgcccggctaatttttgtatttttagtagagacgggattttgccatgttgtccaggctggtctctaactcgtgacctcaggtgatccgcctgcctcagcctcccaaagtgctgggattacaggcgtgagccactgcacctggctgacaaaattttttaaacaatgaccgctctattgtagctaaataccagagaagactatacctctacccctactagcaaaggccaactagagagacttccacccttgccagcctgtaataagacctctagttccctgatagagtggtaagatgaatggggagtgggaacattctagtcccctcagttagtagagactatgtggggagcctagatttccacccctaatgagtgataatgaggtgcctctcccctaacaaatggtgtggtatcaagaggaagcctaatgaagagtcaggtttttatcaccacccaacagtaacaatgatacctgtctatcagtggtctcaatggaggccatttggagagaagtaactgggcacccagtctctcccaagcagagtggtactggtaaaagctggaactgtcacttagcccatggtgacaggaagctcctcaaccccaggtatcagtggaatctgagtatggaacctggacttccacctacatgtggtaaaacagaagatttaaataagacccagatcttcataacataatatgcaaaaatatccaggattcaactgaaaatcacttgtcatagtgagaactgtaataatcacaacttgagtgacaaaagacggtcaacacacatcaacatcaagatggcacagttattagaatcatctgacaaagatttttaaacagccgtcctaaaaatgtttcagtgagcaattgtgaacatgcttagaacaaatgaaaaaaaggatgtcttagcaaagaaattggaaatctctaaaagaaatcagagatataaagaaaaattaataggaaattttaaaactgaaaattttaatacatggactttaaaaaacaaacctcagtagatgaactcaacagcaaaataaaaataacagaagaattaatcagggaacttgaagatagaacaatagaaattattcagtctgaatgacagagaaaaatatactgaaaaacaaaacaacaacaacaaaaaacagagccttaggcacttgttggactattacaaaagatttaaatatgtgtcattgtaatcacagaagagagagagaagaggtactgaaaaagtgttgagagatacaatggctgaaaatgtcccaaatttgggggtgggggagacaatcccacagattgagtgattcaagaagctgagcaaccccccaagaagatacggtcaaagaaaccactttcaaacttctgaaagcttaagacagaacaaaaaatcttgaaacccaccagagcaaaatgacaccttacctatagagaataccaaagcaatgacagacagaagctctctcattagataccatagaggccacaatatttttcaagtgctgcaagaaaagactcattaacctggaattaaatacccaatgaaaataaaatacccaatgaaaataaaatatcctttagtaatgaagagtaaatcaagacatttccagaagaaggaaaactaagaatttgtttctagcctacctatcctaaaataatggccaaaggaagttcttataaaagaaattaagaattctaacaattgttcaaagaaggatgaacagcatttctacacaatctcatccagaaaataagaggaaacaacttccattaattctatgaagtcagtcttaccctcatcccgaaaccaaagtacacgaaagaaacttacacattaatatgtctcacgaacatagacgcaaaagtctttaacagaatattagtaagtcaaatccagtgttgtagaaaacgttatacaccatgaccaagtggaatttattccatgtacggttcagcatccataaatccagcaatgtaatccattatatcaacaggctaaagaataaaagccattatcatattgattgacaaagaaaaagcattttagaaaatccaacagttcatttttgctaaaaactgtcagcaacccactaatagagagtaacttcctcaatttgattttttaagatatgcactaaaccttcacctggcatcagacttaatggtgagagactgaatttctccttgccatcaggaacaaggtaagtatttgcactcaccactgctatcaaaatagtattgggttgctggatcatatgacagttctgtttttagttttttgaggaacctctatactgtttctaaagtggctgtattaatttacattccaaaaaaaatgtatgagtgttcctctttctccacatccttgccaacatccattactttttgtctttttggtaatagccattattaactggagagaaattatatctctttgtggttttgatttatatttctctaatgactagtgatggtgagcattttaaaaatatattcccttggtcatttgtatgccttttgagaattatctattcaggtcatttacccatttttaaattggagtatttgcggagtgtgtatgtgtgtgtgtgtttctattgagttattggagttccttatatattctggttattaaattccttgtcagttgaatagtttgcaaatattttctcccatcctgtaggttttctcttcactttgttgattgtttcctttgctgtgcagaagctttttagcttgatgtgatcccatttgttcattttttctttgtttgaggtgcttttgaggtcttactaaaaaaatctttgcccaaaccaatcccggggcacttccctaatgttttcttccagtactttaatagttataggtcttatatttaagtctttaacccattctgacttgatttttgtatatggtgagagataggtccaaaagaaagaaaaatcaatatatcaaagagataactggattcttgtgtttattgtagcactattcacaatgccgagatagggaatcaacctaagggtccatcagtggatgaatggataaagaaaatatggtatatatgcacaatgaaatattattcagccataaaaataaggagagcctgtcatttgcagcaacatggatggaactggaggacattatattaagtgaaataagctagacacagaaagacaaatattacatattctcacttatatgcaggagctaaggaaaatttgatttcatggaagtagagagtagagtgatgattaccagaggctgagaagggtggggggtggggagcttaaagaggggttgtttaaggggtacaaaaatacagttagatagtaggaataagacttagtagtcagtagcacaatacagtgactatagttaacaatcatttattgtatgtttcaaaataactaggggagtggatttggaacgttcccaatacaaagaaatgataaatgtttgaggtgatggatatctcagttaccctgatgagatcattatacaagatcataccctgatgagatcattatacatcatatacatgtatcaaagtatcacatgtaacccatgaatatatacaacaaatatgtatccataaaaattaaaaattaaaggtaaatctaagcatgcttcttaaaaaacaaagcacaacaaaaagcaaaataataatggaaattctagccagctcagtaaagaaagaaaagcaatacagatcagaaaggaagaaataaaactcactatttccagatgtcatgatagtatatgtagaaattcccaaaatctacaaaaaaaaagaaaaaatctcctagaactaataagtgagtttagcaggtcacagggtacaaggtcaacttaccaatatcaattttatttctatatcctagcaatgagcacgtggaaattaaaaatagaatactgggctgggcacagtggctcacacttgtaatcccagcactttgggaggctgaggcgggagcaatcacttcagctcaggagttcgaaaccagcctaggcaacatagggagaccacatctctacaaaaattcaaataattaactgggcatggtgtcacgcacctgtggtcccagctacttgggaggctgaagtgggaggatcgcttgagcccaagagttgaaggctgcagtaagccatgatcgcaccattgcactccagcctcagcaacagaacaaggccctgtctcaaaacaaagaagaaaaaaaagagaatacaatgactcaaaaaaaaaaaaaaaaggtgaaatacgtgtaaattgacaaaacatatgcaatatttctatactaaaaactacaacgttagtgaagaaattaaagaagagcaaaataaatggagaagcacatatcgtcacattcatggattgtaagaatcaatgtaaaaaatgatattaattttccctaaattgatacacagtttaagtgcagttcctatcaaaatccctgcaagatgttttgtagctataaataagattatcccaaaatatatggaaagacaaaagaaccagaataatacataaaataattttgaaaaagaaagataaagtgggagaaatcattctattcaaatttgagactactgactattataatcaagactgtaggatttgatagatgaacagacacagaaaatagaatagaacagagaactcagaaattgcctcacaaatatgccagctgattttcgacaaaggtacaaaaacaattcaaaggaagaaggatcaccctttaatcaccctgtactggcctgactggatatccatagctctgacacccgcccccctgccccctccccgctgccaaatgaacttcagcttaaacttcacacctcattaaaacttaatctcaaatggatgacagacatcaatgtaaaaattaaaaccataaaacttttagaagatattgtaggagaaaattgtgaggtactagggcttgttgaagagttcttagaaatgaaataaaacccacaatccataaaaggaaaaaaaaaaaccaataaattgaatttcttcaaaatttcccctgcaaaagtctctgcaatctgggagaaagtatttgcaaaccatatatctgacaaaagactcatacataaaatacatgaactctcaatattcaacagtaaaagagaaaagaaagaaaacaatgcaattaagggtaatgggggctgggaaggaggtggggatggttaatgggtacaaaaaatacttagaaacaatggataagacctactacttgatagcacaatagggtgactatagttaattgtacattttaaagtaacatagtgtaattgggttgtttgtaactcaaaggataaatgcttgaggggatggattctcagtgatgtgcttattttacattgcattcctgtatcaaaacgtctcatgtaccccatgaatatatatacctactatgtacccacaaaatttttttaattaaaaaataggtaaaaggcatgaagaggcatttaatcaaagaggatatatggatggcagaaaagcacatgtaaagatgttcaacatcattagccattagggaaatgcaaattaaaaccacagtaagatattactacacacctatggccaaaatatactgacaccagcagatgctagcaaggatttggagaaactgtatccttcacacatagctggtgggaatgtcaaatggtatgatcactctaggaaagtttggtaatttcttgtaaaactaacatgcacttactatataccccaacaattgcactcttgggtacttatcccagagaattgggaacttaggttcacacagatacttgtacacaaatgtgtgtagcagcttcattcacagtagcccaaaactggaaatgacccagatgtctttcagtgggtgaatggttaaaccaactgttgtagcacctctataccatgtaatagtactcaacaataaaacaagaaactctgatacacaagacaactgggatgcatctcacaggcattatgctgagtgtgaaaaaagccaatctcaaaatgtgacatattgtatgattacattttcatgacctcttgaaatgataaaattatagagatggagaacacattagtggctgccaggggttagggatgggggcggtggaggagggttggttgtgactataatggggtagtaagagggaaatctttgtggtgatgaaatagttctgtgtcttgattgctgtggtgtttgtagagacttccacatgtgataaggtgatatagaactatatacacatattgtaccaatgtcagtgtcttggttttgattttgtactgcagttacacagatgtaaccattggggaagcagataaagggtacatagaacctcactgtactatcctcgcaattccctgtgtatctgtaattatttcaaaataaaaagtttaaaaagttttttaaaagcagaattaataaaatattacctaaaagcagtagggcatcagttatatttcaaaaatcatgtcatagggccgggcatggtggctcatgcctgtaatcctaacactttgggaggctgaggtgggtggatcacctgaggtcaggagttctacaccagcctggccaacatggtgaaaccccatctctcctgaaaatagaaaaattatccgggcgtggtggtgggtgcctgtaatcccagttactcgggaggctctagcaggagaatcacttgaacctgggaggtggaggttgtagtgagctgagatcatgccactgcactccagcctgagtgaaagagtgagactctgtctcaaaaaaaaaaaaaaaaaaaaaaaaagccatatgtattagctggttggataccattgctgccgctactgaacagtggacaccggatgttagccctgccactaatgctgcccctagaaactggattttcttgtggctgctgctcccaccaccacaactatggtggtgaattccatcactgcatatttgaatcactcctttgaaacaaagtgttaggtctaagttgtaactgcagtgaaagggttgtactcagcaggtctgcaatgttcaaaccctatgctttccaaaaaaaggtcttttgcaaagaatgctttggctcttgaccagctcttgggagataatctgtaagcccttggaagtatcctgcctgatcagagtgtctttgtttactgtggccttggcccacactggatagtttgtgctaacagtgtgatttgtggtgtgagccttgggctgagagatactagtttaacctctgcatggactagagactgaataactaaggtcaaccacacaggtgctccatgcctatctgactgaaccccaaaaacaactctgggcaccaaggcttgggtgaacttccctggttgacagtatttcatacatgttttcacacatcattgttgggggaattaagcactggccatacaactccattgggagagtacaactgaaaagtcgtgcctggtctctcctgaatttttccctatgcactttttacttttgctgattttaatctgtatcctttcactgtaataaacaatagccataacactttttctgagttctccgaatccttctagcaaatcattgaatctgaggatggtcttcaggagcttgccacactggtaaatcctagatcacattctcttagctgccaagggcatgtgaagaagtgaatatctggcctttgtggcttttgcacttggaactgttaagtaagaatatatatgaccttactaaaatgttaaaaatcgaaatacatctggccccaagggttttcagtaaggatctataacgctatataaagaactcctaaaagtcagtaagacagacaacccaaatgaaaaacaggtaaaatatacaagcatattacaaaataaatctaatatgttcattaatgtataaaaatgtgttctaccacattgcttatcagaaatataaattaaaaccataaggagataccaataaatacacataagattggcaaaaaaaaaaaaaaaaaggaaaagtcttgtagagtatgtcagtcttactcctgggcttctggtgtcacggaaataaagacaaacattaattattaaagtataagaatacatgtacaagtatttttattgcaatgttgttgtattgccacgctccccacaaaaatcctgaaactaaaatggattccatccatgggggaatggttaaatacattgtggtacattcttaccatggaatattatgcagtcatttaaaagaacgaatcacaggtagactgttgtcaaataagataattcagacacataaaagttcatgtaatcttaaatttgtaaaaataaaaaacaacttttgagtatggaaggatatcaaatggtgttaaaaacaagtgtttggcaggtgaaggtagaattgaaaggaagtgggaagcagtaaggaaaagaatgcaatttaaggtctggcatatataacacatcatttatgtaacaacatatatgtgtgtaaagtatgaaaaggtagcaccaaatctaagcaattgtccaaggtgatgagatttagtgatgtttatttaatttctaaaatatttaggcagtgtttgaatgtatagtgatgagtgtgcattatttgtataatgaggaaaaataagtgaattgatcacaggaaaaattgcctctcaggtttcttgctttagcaatgggatggagagtgcgattcattcatttaacaaatatttattgaggatataaaaatgtgccaggcatggttctaggtgctggggaaacaacaatgaataaaacaaaaatctgtctccctaagaggtttacactctaaatgggggagaaaggcataactagaggagaaacactgtgttggtgggaaggaggaggcgtatgaaggaatcggtttgggacctgttaatttagagaatactgagagatatccatttggagaagtgaggtaggtagttactatggatctagaattcataggccaagtcatgaccgaagatacagatatggaaacagatagcatagaaaatggtgtttctgacctcctttcctgagtctgatcacgtctcactgcagacactttacagaggaagtgctgaggaaaaacaggcagctgacagaggaggttgctatgcaacagatgaggaaagtcatccagccaggcagaactgatgttggcccttggggaccaaatgctgcagtccttcctagcattagcttcctttcatgttcaggcttctggcatgagttgatgccagaacaaatgtgaactgcacaaagatctgtcttgaattttggaactgtaccagtttaatttgagtcacctcacatctgtatttaattttctgcctttttgagtttctccagttatcctggaagcatagcagcgtgtgtgtccttgggtaggacccacttgctgtgcattccactttgcacattgagaaaccaggcccagagaattgagtgacccgtgcgggctcacacagctcgagacagacaggctgggcactccattcctggaattctgaagcccagcccagtttctctccataaaaccacagctgccccaggccccagccctgaaaggaaccagggcttgccatggctcagacacacaggtctgattgtcctggctgctccagtgggcaccaggaaggcctcagggacagtgtgattgtatccctgataaggaagaggcctgatgttctgagcacagagtggaccccaaggagcaattcccacgcctggatggacccacacagggcagggggagggtgggggcctctgcttgtgtcctcctgaatgcagagcatgagcttgggcctcctagaacacaaactttgcttgtttggtacaaatggggtgccgtggtctgttgctcaaatggaggagggaggggtacccttagtccccaggccagcatgagcagaatgtgggctttggagtcaggaagacccagacccaaattttgcattttgtttcctggctctgtggccttgtctagttcatgcaatgtatctgtgcctcagcttcctgatctgcaaaataggggtgctgacatccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 2261 - DNA, 4936 bp, Homo sapiens
tttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccag

SEQ ID NO: 2262 - DNA, 4936 bp, Homo sapiens; identical to SEQ ID NO: 2261

SEQ ID NO: 2263 - DNA, 4936 bp, Homo sapiens; identical to SEQ ID NO: 2261

SEQ ID NO: 2264 - DNA, 5145 bp, Homo sapiens
tttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcgaaggggccgatgggaagacgcccagtgaacatgcgcactgaggtgggcaccaaaggagcatgcgcagtgaggttccctcgtgccttaagggctgtggtgcccctccttatcccgccttgccctgtcctatgctccttcccaggtccccattaac

SEQ ID NO: 2265 - DNA, 4992 bp, Homo sapiens
tttggtgaaagctgcaaaactttattgagatagtttaagtcaaatatctaatataaaaccagcttgcgttgtttcagcttgtcttcatttaaacttgtggttgctcttcacctataacagaagcataacaggtgggaacattactagcagaactgtgtttaaatgacattaaggatatggaaaagacaccaaagttttagttttctacaatggacaaaaccagaagcctaagagtcacccttttgcttacattcatgtagacctctgaagagactttgacaacagtcgtccaagtgtatgcattaaagatgtttttcaaacacaccctgctttctagtgctacaaggaaagcaagacagtccaaggtccgaacacattaaatgaagtgaacctactaaaaaggggtttaaagtagaaagcaaacattgtgcatagttttactcaaaataccagcaccacacaaaaatcctaagaaacaaaaaaggaatttacgaaaaatgtataatttttggcaaacactcttttaatattctggcttgaatctgtggtctgcatgccaaacgggctcctggaaatggtctgaatactatcttggaagaaaacggttactgtcaccttaggaactgaataagtaaagtgaatagaaaggccagcattgcatttgtttttactctattgcgcagaagggcaaaaatatttatttgggctcgtttacccttctgtggtttttaaggtacagcaaccgtttgtacccagttttctcctaccgtgatgtcaacatgaatcatgcctctttttacacttgaaagtattcccatttgtataattaagtatatggtcgcattactcttaagctatcactatcagttttgtcatcaatatgtgatagcattatgaactgtgtcacacatgaacacatggagggatacgggaatggaaaacaagagtaggacagctgaaaaagccaaaatttgtttctaaaagtaaatgtttctgagggacaactggaaaatttcacagtttcttccacaggctttgtgatgcttaatcaggtattacagaaataaataatgcatgccttcctagcttaccaaccatttcatccatgctctgaaaatcttagcgttcaagactgtattcactttcaataaagccctgtattaaatcactctgtcttgttcatattccatgttgtgctttttccgtttcttcaagattgtgtaaattactgaatattcgtagctaattttcaaaacaccaatcttttcaatttatgacatttgaactacttttccttatactaatgattcgtacctgtcttttattcactaccactttctttttcctttaagtttattctctggctcttttattgttatttcatagtattcttttcctttaacatgtaacgtgctatttattttaataagacgtgcatttaaagctatgatctccctaagaatacaactgaggcttgttcagtgggctcctggaaatcgtctgagaactatcttttaatgtaaatagtataatggaatggttcagcagggtacagtaaaaacacttaggtaatttctcccttaaacatggggtgcttcctttaacttcaagaggtattgtaattaacagtcaccaatttggaaaatatgtgtaaaacatacttgtgtcaactactcaggaactagcacagtgctgttgttgaacttcaaaccctatcatctaatgcctcaaggcagaaacctgtaatatgtaacctatggtatggttagaggtgactctactatatgagtcttcaatctaattacacgaagtagttcatgaagactgacgggagggcagggagcatgcttagcagaagcatcttacacccaccttgggcatcactgacctacatgcattctctctacttcactggccacagaaacctgatgatctcctgccattttatcattcagtcattcaaggcttcactgcgggaaggctttaaaatgcaattattctttaagagacagagaactcagaatttggcaaaatacaagaacactcatacagggctccacacaggaaaacaaacaccaagcagagtgcccgctcattttcctaggaaccatgaaatctcaactcagacactataattggactgaagctgattgttatgataaacaaatcatgaagatcagaatatcttggtcttctatccaacagaaccagagcatgtggaaattagcaacgaaatggattttaatctatctgatgtgcatccactcttttcactaagagcaaggatgcctgtggaatttatacgattcatccagactctcacaaattatggtagagctggtactagaatctgcttcagggctcagcatacttcacacaaactggtattacaaatgcattatgtgtttgttaaaagcagaaattagaaaagaatctgaaaattgttagctgttggttatacaccaaactaagaaaatgctgtcacgtttgatgattcaatatggctttgacccaatttgtttctgtatctgatagtgtttaagtcttgcaatctggcatttgggtctgaacgacgtttcaaagaacatttgcatttgcactgtgtttttaaagtagcactaatgttatccctctattatcaaaagtataatactgtgtaaatgagaaagcacataactttgcatcttgctggataacatacctgcttctggcattttacagtgttcctctttaggtattatcttcaccttgacgccggaacccaaatccagatttatccccggtgtttgactgatgcagctcttgcagatcaccttccatgtcgcgcacttcaaaatacaaaggttatcgatttaagcattccaacatgaaatataaataaggaaatgataatattctcttccttcgcgttacgaaataaagcctgagccaggcgtagtggttcatgcctgtaatctcagcactttgggaggccgaggtcgcttgaacccaagagctggaggtggcagtgagccaagatcatgccacaacaatccacactgcgtgacagatgagcctctgccacataataaaaaaatgtacatttctatacaccaaattaaatggtttcaagtgatttagtaaggactgtattttcaagcatacaaaatccatctcgaagaacaagagaagattcattatatccagggacagcatgaagctgcaaactatactctcccttttccagccaactttgagcaaatgtttggtatcttttcctaatgttctctttgctcctgttactgctcatggcataggccacaatgcacacatagaccttctcccgccccatagacatactttcccttcccagcacctgggatctcagctgtatcctgatcttcttctgtctgctgcccaggtgtaggatcccgactttcagctgctggttcttctttttggggctctccattactgggctcctgggactggctgtgtggttctgtgtttgtgtgtgtctagataaaaagttttgttattaatacatgtcaataatataaatatacagaatacacaggtatgtcttattataagtatgtctagagacatttctccaacactaccccgtatacctaatcttcataacactattcttccctcagagaggttactcaaagacagatatcctcagggactttggaagccgttttaatcaatgttgggatgaatgtgtgtaatctgttctgaataagcatgaggaggaagttatggacaaaatctgggcacacacgatcatccacccacacaaaacccaaatataaccctctggactaatctttccttcatgggatgccatgatcattttttatcagcatgggagaccattatcagtgtatccatactagtccatcaacactatcagaaaaataactttctgctaagagaaaacatcgaatgttaagacattcacaagcagaggcacaatgagctcaggaggttgtgaacttcttggcataggcctatatgttgatcgtcctcatcaacacatacttcactctgcaagcagaatactgcgattgggaaaatgcacttgacaggacaactagatttgaccgctttcatggtcaaatgttaacttggacattttttttttttttaatttagaaatactctgaaagtccccgggcaagtataagtgtatgcaccttttgaatcgaatgcttgcaaagccacttaagtaggtctagctagctgagcgatgtcttaaggctcctggcaaaaaacacagggcatttcccatgaggttggtttcacaactggacactccatcagggagacaagtaggaaattacagctacagaactgaaactgcagtgaccaccaattttgtcacataatgatttgctaggcccacttcccccccaccccaaagtcacatttttaggaactcagggccccgcccattggaatctccacagtggagttgagaatttgctacacagcagtgggcactcctcacaggacccctatgccaggcactctacagacctcggggctgcggtcactagcccgcagcatgccccgtctccaggacccttccataccgctcatgccgtccctctcctggtcccgtctggggagtccagaatcttctgtcggggttccaggtgcttctgggactcggatacccccaacagcaccccagcttcgcctgagcccctccactcctcggccctccttcctccctagttatggccgtgacgagacaagaaggtccatgggcgtggcaccgcatgagagggacgacgacttcgagggccttctcactctgagtcactgaccacacaaccctccggaagcctgctggttcctcttcactctcactcacacttcaactcccagttggatctgcctgtggacctacccgccgtgtctcagtagcggagaaagaatccagacctcagggacccgagtcgccggctcacagctccgccgcgttccccacactggcga

SEQ ID NO: 2266 - DNA, 4992 bp, Homo sapiens; identical to SEQ ID NO: 2265

SEQ ID NO: 2267 - DNA, 4992 bp, Homo sapiens; identical to SEQ ID NO: 2265

SEQ ID NO: 2268 - DNA, 5145 bp, Homo sapiens; identical to SEQ ID NO: 2264

SEQ ID NO: 2269 - DNA, 5145 bp, Homo sapiens; identical to SEQ ID NO: 2264

SEQ ID NO: 2270 - DNA, 4936 bp, Homo sapiens; identical to SEQ ID NO: 2261

SEQ ID NO: 2271 - DNA, 4992 bp, Homo sapiens; identical to SEQ ID NO: 2265

SEQ ID NO: 2272 - DNA, 5145 bp, Homo sapiens; identical to SEQ ID NO: 2264

SEQ ID NO: 2273 - DNA, 4936 bp, Homo sapiens; identical to SEQ ID NO: 2261

SEQ ID NO: 2274 - DNA, 4992 bp, Homo sapiens; identical to SEQ ID NO: 2265

SEQ ID NO: 2275 - DNA, 10841 bp, Homo sapiens
ggaacgtttgcaaaggtgtattaactgtcagtgactgatacggggaatcagaggaggggagtacatgctgaacaggaaacaaattgaaggggggcttgaccaggactcatggcaatggggaaaagcatatgggagatgcttatactggtacttggtgtgtctgtgtgtgtgtgtgtctgtgtgtgtgtgtttgtgtgtctggtgtgtaaatgcagaggggaaaatcggaaattaaacactcagatctgccctcagtagtcacatctggggagagaggagggtagtgctgttctatggagagaatacctgactatacttgctttctgaggtaggtgcatggatacacaaaccgaaatacacattaagcatgtcttgctcatcaatgaaaacgctaatatctaacagaatggcacactgtaagaaaatacaatggaaacactaacatcgaactcttgtcacactaagaaaaacgacgctcaacttttcactgttgtgaacacttgctttcacttgctatgcacctgatgacgaggggtccgcagccatgcccatgttcgtgaaaggtcaccacgttctgcttctcatcatgggcatatgtcgtatccccgaggctgaggcaagaagagagaaggaaagtaagtggcagtgagttcccaccacgtgacaactcaatctcaactcctcctgacctgcagaccctgcacactctgattctgccctaccccaggacctgcacacgccttccatggttccttgaagtgaaccatccgctcatgccacagtgacttcttcgcctgggttatccattcctaggctagaggaaggtgtggcccacatacagggctgatctggagttcgggaacccacagcatcctgggtagggagcattcctggatatacagggcagggagtaaaaagagcttacgaaggccaggcgcggtggttcacgcctgtaatcccagaactttgggaggccgaggcgggcggatcacgaggtcaggagaccgagaccatcctggctaacacggtgaaaccccgtctctaccaaaaatacaaaaaaaattacccgggcgtggtggcgggcacttgtagtcccagctactggagaggctgaggcaggagaatggcgtgaacccgtgaggcggagcttgcagtaagcggagatcatgctgctgcactgcagcctgggccacaaagggcgaatccgtcaaaaaaaaaaaaaaaacgtgggaaatctctcatcattcggcctcaatgctgtaccctagaaaattatgagacgggaatgatttggggagcaagtgacagatgggataccagtatcataacagaataccacatctgcagggatgtgggggatgagccgaaggttcacttacggagttactcgtcgtcttcttcagggtcgctgatctcttcataaatcaccagctgctttctctcacgcagtctgtgggtccaggcatgtttcccccttttgggtcctgtgatggagaatagttggaaagtgagggttgggtaggttggagagtgttaggctctgttttctcaaaaaaaggagatgcctcccccctcccaagtgcccatgggccttctttatccagtttttcacattctctggcttagagaggctgagaccttagacccacaccaatacaggccaaatgccaattaaagttttagcttctggctccttctgttgtggggtttagattcccaaccttttcacttacgggaacatccacccttacctcctttcattcagcacgtgtttttattgagggcaccgaggcatacttttttttattgcacaacattttcatagtgcttcacagatgctgcaatgtttttttttggaaactctcatcaattttacacctttccgttattattatatctgttatagtgatctgtgatcagtgagctttgatattattactgaaattgtttttgttgttttttagtcttttaaaataattttaattttttaatttttaatttttattttattttattttgtttgagatgaagtctcgctctgtcgcccagactggagtgcagtggagcaatctcagctcactgcaacctctgcctctccagttcaagcgattctcctgcctcagcctcccgagtagctgggactacaggagcatgtcaccacgcctggctaatattttgtatttttagtagagacggggtttcaccgtattagccaggatggtctcgatctcccgacttcgtgatctgcctgcctcggcctcccaaagtgctgggatcacaggcgtgagccacggcgcccgtccgtgttttttatttttgtgcatacacagtaggtgtatatacttatggggtacgtgagatgttttgatacacgcatgccatgcgtaataatcacatcatggaaaatagggtatccatcccttcaaccacttatccttgtgttataaacaatccaattacactcttctagtttttttaaaatgtacaattaagttattattgacaataatcaccctgttctgtgtaattgtttggggggtgggtaccaggaactgcacccatagaagatgacaaacttaatcgattaatgttgtgtgtcttctgactgctccaccgatgagctattccccatctctcctccttttcttggacctccctatttcttgagacacacctatattgaaattaggatgattgacaaccctataatggccgctaagtattcaaatgaaaggaagagtcgcgtgtctcacactgtacatcagaagctagaaatggctaagcttagtgaggaaggcatgctgaaagccaagacaggctgaaagctcggcctcttgcaccaaacagccaagctgtgaatgcaaaggaaaagttcttgaaggaaataatagtatataatgcaaagggaaagtccttgaaggaaataataatattaacactccagtgaacacacgaataagaaagcaaaactgccttactgctcaaatagagaaagtttgagtggtcaggatatttgatgaaaccagccacaacattcccttaagccaaagtctaattcagagcaagaccagaactctcttccagtccatgaaagctgagagaggtgaagaagctgcaggagaaatgtgtgaagctagcagaggttggttcatgaagtttaaggaaagaagccatctccataacttaaaagtgcaaggtgaagcagcaaaccctgatggagaagctgcagcaagttatccagaagatctagctaagatcactgttgaaggtggctacactaaacaacagattttcaatgtagataaaatagccttctattggaaggagatgccttctaggactttcatagctagagagaattgactcgaactttgaaagaagttctactgtgggtaaaatgctgtccatagcatcacatactacagagaaatccttcatgaagcagagagttaatcaatgtggcaaatttcattgttgtgttcttttaagaaactgccacagccactccacccttcagcaaccaccaccttgatcagccagcagccatcaacaccgaggcaagaccctccaccagcaaaaagagtgagtcactgaagactcagaagattattagcatttttgacaatgaattattttaaaataaaggtatgtacatttttagacataatgctattgcactcttagtagactgcagtatagtgtaaacataatgtttttatgcactgctaaaccaaaaaaacaatgtgtgtgactcacattattgcagtggtctggaaccgaatctgcaatatctctgaagtacaactttattgggtatcaggcattgagctgagtaagatattatcccaggttatcaaagatagaatcgcttgagcacctttcatgtcatcaggccttctagattaaatttaatgtctccaaacaatttatgaactatgattctttatttccatcttatggactaggaatctggaactgagaaaatttggaagactagccccaagtcacgtggtttgtatatgggtgacaactccagtctgtatctctggaagtccagtcaaacatctcatctggagctgggcgagctcctcagcccagcctggacccaggcttgtctggggtccatgccacacacccagtccacacacctgaacatagccacggaagccagagggtttgttcccgaattctttcctcttaccggatgtcttgttaatcttctcagaggtacttggttttcctggagggcacaggtgtttcccatcgttctgtgagccagatgcttctggcactcccttcgaatcatttccttcctctgctggcttcttgggcatgatctttataatgtgaaggtcacagataaacagaatcagtgacatttctatagtgctttagagcttacaaagcgtcttcacatgcattaccttaatcaatgttctcaacaatgctgggagagttacacatgcctaaattaggagaaacctgggaagttagacgggaaaggaatggcctatgtgaatatcgtttccagggctagaatgcttatcttcacactctttaagactgacattcttgcaaacagtaaaaatctccatgcaattgagagtttggtatacaaaagattggaagaaggatagcatttttaaaattcacaaggtctacaaaaggaagagcttctatgaaatacaagggatctcatataagctcttagctgctgggagagtaaatgtaaaaacatagagaggggacaaaacactgctgggaaagatggtgtggggagattaatacagggaagggagaggtaaagaaatggtttgctaaaattaatctaggcagcgaagaaagcagtaccagatctggcataccaccctaccgaggcaccaacactgaatgtggaattcagtgaggtggtacccataccaattctggttgcattgggatgtgtcactgaccaacaatcttaagctacttttttttttgttgttttgttttgagacagagtctcactctgtcaccaggctgcagtgcagtggcacgatctcagctcactgcaacatccaactcctgtgtttaagtgactcatgcaacagcctccagagtatctgggactgcaggcaggcgctaccacgccccgctaagttttgtatttttaatagagatgaggttttaccatgttgggcaggatggtcttgacctcttgacctagtgatccatccacctcagcctcccaaagtgctgggattacagtcgctagccaccgtgccccgctcttaatctactttttattcagcttccttgcttatgagatagtgaacaatacatgtaaaatagtctacgggaaagtcctctctgagcttgtaaacactgtttaaatgcagtaataataacaattaatacctttcatgatccttccttcaattcggtctccacactagcaacccaactcccagatccctttaccctctaaaccagagttgaatctgcacttgtggggtcactcattcaggggcctccgagggatcccctgggctgggatgggggcttctgggatgccccaggtgcagacaaggtcctcaaggagctcacagtagggaggggccaacagtcaaaacgattcctaagccatgcaagtggtcccagtaacagagcagaggccagctggtctttcctattgcgagaatgggtgtctcaatggaagcaccagcaggccctatggggtgaagccctagtgagcaacatctgaacttcataaacaaatgcaaacgtgaatgagctttaaatggcttggagctctggattagactaccactgccactgtgccccaggaaaattatttaacatatctataccccaatagcctcattttattattatgttgctgataactacgattctttacttccatttcatggaccaggaatctggagctcagagaacttagaagacttgtgccaagtcacatggcttttatatggacgacaaccgaagtgtgtgactcattattatttggagataataatagaaacaaagtcatacaggtcttcttaaggattaaatacattaatccatgtgaactgcttaaaatagtatctggcatcactatgaaaacaaaagatgtattaaggatcacaactgttagtattattaagctgttggtgctacatcaggtgttgtgatagacatggggagaaggaggcagtgagggcattttttatattctcccactcttaccagtgtttgcatccatggagggacaaaggttctctggtcctttagatctgagagacactcaccttcgggaagattctctggagcctgcaaaaagtcatctgaggacgttcaactgaaagagaatatatcagaatttttctttgttggtaaagatttccaaactctagagacttctgtagcatcagggtattctgcagcagagtgttatgagtccactcattgttgaggagttatttcagttttgcttctgaattatgtttagtcatggttgattcatttatctgtggcatcaattcagaattttccatctcatggtttatcaaatggggactaaaccccatcacagtctcatcttattcctttacatatcttttatttttttccaaataattaaattgattggttaggaatctgaactgtatccactcaagatgtgcaacaactgaaaatcattgcacacttcaaatgggtgaatcttatggtatgtgaattaagctgttaaatgtgtgatgaaccatggatgatttagtccagtggctctgagatattttcagtataaagacagtcctttaatgtcaaaatcttggcagacacccaagcactggattttcagatctcttacagtgatcgtgggagattttagaatctggcctttttagttggggagtaataggtctattggagacagtttggacgttctgaccttgtcttataattgtgttgtcagagcagaagagcaaggaaacacatatgtgacccctttatattcccaaaacgtacaaagatctctaccgaagaacctgtctttttttcaccctatgttatctctgctctctggcaagtgggaaagctctctctgtgtgttggatgagggatcactctttcaaactctcttccaagctcatcacggagaatcagggttctttgggaatgaaaagactatttggctctgataaaatacagagaaacagcgatctttattacataatgtgttcatcatcctcactcctaagatacctatccaatacctacatgctgttaatgagacaaactctggaagtttttggcgaatctacagttgtaacattttctttcttctttttttctcttgtaacatttttttagcagtcctttgattcattaatggtgcttaggaagaacaacatgtcatctaaaaaagaaatatttcaaacacacagaaaagtatgaggaataatattgagtccagtcggatctcaacattaccccacagctatgctaggtttgatttatttattcacaatattagaaaaactacaaacaggccgggcatggtagctcacacttgtaatcccagcactttgggaggctgaggcaggtggatcacctgaggtcaggaagtttgagaccagcctggtcaacatggtaaaaccccgtctctaccaaaaataaaaaatgagctgggtgtgggggcgggcacccgtaaccccagctactccggaggctgaggcaggagaatcacttgaacccaggaggtgaaagttggagtgagctgagattgccttattgcactctaccctggccgagaagagtgaaactccatctcaaaaacaaaaacaaacaaaacacactatcaacaagtcacagctgaagctgtctgtgcagcactcagcaatccctgcccgccctccctcctccacttacagccagtcacctcaatttgatggctttttattcacattcatgtttgtatacatttaccatttacttattatctataaaaatatatattcttgtttttcgtgttttaaaattttatatgaatggcctctgtagttaactttctgcatgcaatttttttttttttcactcagccctgatgtgtatgagggaacaaatgcctgaggatctttcccaagtagctgagctgaaaagcagctgggcttgaggagaccctttccagccccttcccgtctactcaccctgattcccttggttacggtcattatcaaaatcattcccctggaggtctgtggcccctgtattatgcatgaaaggtgggagggtggccttgaagcctagaaagaagcaaaatgtttattccttaagagacaagctttgacctgtcacggtggctcatatctgtagtaccagtgctttgggaggctgaggctggagtattgcttgaggccaggagttcaaggctgcagtgagctatgactgcactactgcaaactagcctaggtgacagactgagactcagactcaaaaaaaaagaaagaaagaaagatacaagccgagagaaggaaggtagggacggtgtgggggtgccgggatgccacagagacacttggactcatcagaacagaagcctaagggagagaaacgtgcaggatccaggtatgagctccactgtggccagtccctgccctcagccctgacaggatacagaagaggagaacacccagaagctgccttgcgatttttccctgcacaaaaggaaaatgtggggtactttctgcagcctaagaagtagccaaagcaggaatagggatgctcatgtgtccccagacttgtctgtacctagaactttctgttacctagtttagtcatggcctcatactttctcttcatatacacatagctgattttctccaaggatttcatcttttcccactctttcttagagaagtatttggcaatatcatcgaaggactaggaaaagataaaaaaggaattttgtcagtgactcagctagacatgtctgccattcagctggagccccttcctgtgtgctggatctgggaagtggggatgatgccatggctaaccgacaacatgagcgacctttcctagcttcacccctgccacacagtagggctttaatgctgctgactgactctcttcccactttccagaatggactgagattcaccaaatgtagtgcacggtcacagacttgtctccaaggatgctagttgatgacagagcgaggatgggaggctctcaaggatccagatctcccccaagaccctggtccttgtctccagtatctctgtcctcccctcctcagaaacttggccaccccacactgtcccctgggccactactctgctccctccaggtcacctcaccttttggatcttctctggtatttgagcaccagccctaggtctccttgcaaaggcgtcgtctccgttcatggcaccaggagcagtctgacctgcaagagaaatagcctgagtctttccagccacagcagctttggtcttgtggagggagaaatcagtgaaggccggccaccctcagtcacctggaatcaggtgcttcatttctccatctggggcttatctgtccctgagtaatgacatggggcgaagtcagatgaaaatagggaaccaggggtctctgggagaagtattgatttgggatgacaggcttcctgtgggcaaagcagccttgagtctttgggagggggttggctaatgttgttagtagtttccctggggctagccttactctgaaagatgtacagacccttgttgggaaggcagagatgtgactgtgtaattttattcagtgggggcatgctgacaccccgactcaataaataatggaagggaaatgagtcccagagataacatcgtctctctggtgatggatctgatcaggcagagggatagggggttctgttctgttgaagagaaatgagcatggctaatatgaacggatttagaggctattactgggtgatttgtaaattattagaagaagagagctagaatttctgagactacaagagcccgccatcacttagagagaatgtagggagtttcaaggtgcagcaatcagccaggcgcagtggctcacgcctgtaatcccagcactttgggaggccaaggagggcggatcgcttgagcccatgagcttgagaccagcctggccaacataccgaaaccatctctactaaaacaacaacaacaacaaaacacacacacacacacacacattaacagaagcggagtggtgtgcacctctagtcccaaggcctacgcgagaggatcacttgatcccaggaggaaagatttgagtgagtttttttttttttttttttttgagtcatggtctctctctgctgcccaggctgggatgcagtggtgtgatcatggctcactgcaacctccgcctcctgggttcaagtgatccaccagctgtggcctccaaaactgctggaattacaagcgtgagccaccgtacccggcccaaatttgttaagttactagagttcccaggaaaaatcccatacctgaaaaagttagaaactgacaggaaggatttgagatggcgacctgcctcacatacactccttattaaaactagataacaaatgcaccacagaggaggggaggggtagtaagaatggaaaaagaaaatcagcgcatgcttactctgattttggaagaatcaaaagagaaaatcagaccgtgcgtactctgagtatggaagaatcgagagagaaagtcagagcatgcatactctgaacttaaagtagccaatcccaggggatgctttaggcgggaaaatcagagtctccacccccactttgagaaggttctgtccctggagcctgg

SEQ ID NO: 2276 - DNA, 5145 bp, Homo sapiens; identical to SEQ ID NO: 2264

SEQ ID NO: 2277 - DNA, 10205 bp, Homo sapiens
cggatacgtcgacaatagatgacggggctcacgttgtacgttcacatcaggtcccggcccgccggaacctgggcgatccacgatgccgagtttgccacgctgcgacagcccataggcttgcccccccgggcattcgggtggactacgaacacaaactgaagccctaggacttgtcgcccgtttgcgctctcgccgaggcacaggctgctcgcggaccaccctgctccgaaaactaaggtgggccctggggcgcggaggacaggaatgcgggcggaggctattgaggcacgcctgcactgtcccgcctgcggggaaaggagggaggtccgccctgggcgccgtagctgtgtatggttcgggcggctggcaccgggtgggttctagacccaaggtttgtctgcagaaggggaccagtagacggggtggattcgaggtggggacatgggacgcagcggtcggagccgcctggaggggtacccggtggtcccgatggagctatcatctttgaggtattgatgaggagggacggggagtgtggtcagaaggctgttttgggaggttgggtggagcgtgagggtggggtgttactggggaatcaatgggggctaataagaatattttagtcgaactgttgttcattgattgattaatgaggggatggcagagtaagcaactagaatataacgagtgatggatgggaaaatgatcccccaggtattgatggaggtatgatattcaacgggttaatggaaagtgatggggcatcgtaatggcaaggatgatggtgaggttgtggggggaataatagatggatggaggtcatgatcaaggggccttggtgaaagaaaagataatgagaggctgatggtgttgtagtcagagtcagtagttgggctatggtggcatgaccgtcgaggaattaggggacagagtgagtaaagagagggcaatagtaaactagggttgggggggttaacttctgttgatacatagtaggtgaatagtaaactgttggagtgtgatcatccagtgatggatccatggagagcagggtggacagtgaggggagaatggggaactgatgtgtgatcagttaacgtgtttgttaatgaaagagttacagggcaggaggctagtgctgtgatctatgaagggtctattggagaaaactgagttaatgggggctgataaatcagtaattgaatgcttaatggggagctaatagaccatgattctccaggcattgttagaggttcataaggatgtagtaataaaggggcctaatcatctaagggattaatggcgaatggggtgaaacgagagagatatagggagtgggaggtacaatgaagtagtattaggataaaggtggaaaacaagggattaatgggggctaataggactatatgaatctaggggcaatggggacaactggggatacagtcagtgagattttaatgggcatgacatgagcagagaagggttgatagtggcagttgcagggtttaatgtgtggagtgtgggtgacagtgatgggaggtggacaggttcacaagtgggccatctatgggatgaatgttgggtttatggggtcttttgtgggaactgtggggtaagtgatgggggcgaggagggtctgtgtgataagcagtggagcctgagagttcagtgattgggtccttcaggccctataaggtcagtggggtcagtgccagggcttcagtcagcccatcttctgtgtgagctgtcatgtgggtcagatgagcccagtttagtttgtgtggttctctccgccctacagaggtaggtggtagcccattcatctggttactgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggtaagtgtgggggtcccagatgggagacccaggagggccggctgggtgggaggggcccgggagcgaaactaggctgatgtgggccatgttgtccacaggggccaagggtccggccacgtggtggctgtggacctgcaggctatggctccactaccaggtgtggtacagatccagggggacatcacccaggtaagagcatggctgagggtgttggggtatatcctgggtgaaggcccttacctggggtctatgcagagtggaagagaaacagagaggtgatagaaacagagagagaaagagagtgagagagtaaccatggagaaacagtcagcaggtcatcattgcacagacacagcagaaaatgatgatgctgggtccccagaggtggagcccagtcttagagaggcaaagcctgggaatttggctgacccaggggctgtgggccaggaccatgggcaggcgggatctgagggcagcagtggagggccgtggggccactcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctctcccttccgcactcagctttctcccacatctggcaacttctccctacctctgctgcctgttctctctctgcctctctcttcctcccacttgcaccccaccctttgagtttcatgtctgttgtctacctttccctgctctcatctctctgcaactgtccaattccgttgcactgttcattcattttcagccagccagccattcaacacacatttactgagcacctattgtgttgggaaaacattcatgaataaaattccattaatctttaacctcatggagctgatgttctagtgggagcaaatgggaaagaaaataaatgattcagctctgtaccattaaaaggggatggggccaggcatggtggcttccacctgtaatcccagtgctttgggaggatgaggtgagaggaacacttgaggcaggagtttgagaccagccttgcaacatagcaagaccctgtcttaaaatattagctggcatggtgatgcatgcccatagtcccagttactcaggaggctgaggtgggaggatcacttgagcccaagaggtcgaggttacagtacactttgatcgcaccactgcactccagcctgggcaacagagtgagaccctctctctaaaaaaacggggtgaggaggccgggcacagtggctcacgcctgtaatcccagcactttgggaggctgaggtggtcagatcacctgaggtcaggagttcgagaccagcctgaccaatatgatgaaaccccatctctactaaaaatacaaaaattagccaggtgtggtggcatgtgcctgtaatcccagctacttgggaggctaagacagaagaatcgcttgaacccgggaggcggaggttgcagtgagctgagatcgcaccattgcactccagcctgagcaacaagagcgaaactccgtctcaaaaaaaaaaggtggggtgggggatgggtaccatagggaaatcattgagcaggaggaaagcaggagtacctgttggaattttaaatcaagtggatggggaaggcctcactgacttaacagcagagactaaaggaggtgggggagtaagctatggatatgtctggaggaagagcaatccaggaaaaattgcagcccgtgcaaaggtcctgaggcaggagggtgcttgctatgtatgagtaatgacaagcagatcactgtggttggaacagagtgagggggggagagtggtaaaaggtaacatcagagaggtaacaggggacagatcctatagggcctcgtgggccatggtgaggctgttggcattttcaccgagatgagagcttggagaaaaccatgagagggttgtgaggagaagaggactgtgctgggcttgggctactatgagctgtgtgagggccaagggcagaagcaggggctccggggtggagtagtccaggcaagtgataatgggtgagggcagtggtggagaggagaagatcaagtcagatcttttgaaagtagatgtgttaatggcttcgatgtgggtgtgaggagaggatgcggggggagcatcagaggtgactaaggttttggatttgaacaattagaaagctcagatgagatggggaggatggtgggaggagcaggtttggggaggtaggtcaggagtttggttgtggatgtattggagatgtagaatctgatttgtgaatctggagttcagaggaacagtctgggctggaggtggaaatgataatgatgcttgtgtgtgaggttgttttagaattgaaatgagttcctaagggttaggagctcagaatatgcatccagttggcagacagtaatttgcatctggaaccttagcagtaagacagcctggaaaatgtatttagtgtctgatctgtgtggtacaagaagatgcacagagccagatgggacccccctaacgctgttcctcttgccacagtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaaggtaagtctcaaggaacttggtggagtagagggaggtcgctgagggccaccctcacccgctgtctttgccttctcaccctgcagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgcagtgaaaaatagcagggcaccgatgttttagaaggggtgattatggagggcctccccgaggaggtgatctgaaccaaatgaaggatttctggtggggtgggaagagagtagctggtggatatgtggggagggtttggcagccataccgccgcctgtgtcatgactggccccaggcatcctgaccttgtcctcagttgtctccccctgttcctaagacccagatttcaaccagctggatggtcccacccgcatcattgtgccttttgtgacctgtggggacctgagctcctatgattcggaccgcagttacccactggacgtgagtgcccaaccaacagtaggtgggtgggagggaggctgtcctaggttaccaggtcctcaccatctccctacccctctgtccctgcagctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatatgtgagtcacttttctttttcttgggtagatggaagacaatgaaatgagttgttcaccttaacccattacggtaagtttgccttgttatctaagagtttgagtaagggcaacctttatgaaaaacctcagtaaaatttcacctttgaaatttttatgtcaactgataagattttaatcaacaaacccttttctaaacatctgttgttgtatgccaggaactgctttaagcattttacatttgaggcattcagtaaacatttattgagcacatactgtatgtcaggtgttgttctaggtttggagatagagcagggagcaaaacagaaatatcttggctctcacagtacttccagtttggaaaagaggcaacaatcaaaacagtctgtaagtgcaagagtttacatacacatatatactatatagcttgcatttctcaatttacatatcttgcaatatatataatatataagagtaatatgggatataaaaaatagaaaaaagtaaagcagggtgaagagaatcaggaattctaggcatggcagttttcatcttttggtgtttttgttttgagacaaggtctcactctgtcgcccaggctggagttcagtggtgtgatttcccgggctcaaaaaatcctcccacctcagcctctcaagtagctgggactacaggcatgtaccaccatgcctagcaaatttttgtatttttaggggagatggagttttgccatgttgcccaggctggtctcgatctactgggctcgagcgatctgccatcctcggcctcccaaagtaccaggattacaggcatgagccactgcgcccagccagtttgcactttttaaaagggttgtcatagaaggcctcagacattcctcagaggtaatgtttgagcaaagacctgaaggcactgccggagggaagccatgtgtttatctgagggaagagcattctgggtaaaggaaataggcatgtcccaaaggtggaactgcacgtggtatgggaggaaagtttatccatagccaaatgttctaaaaccacgatgttagaggatggccctttctgacaatggcatagcaggttattcagactaagtcagccatcacaaaaagccacctttttttttttcttgagacagagtcttactctgttacccaggctggagtgcagtggcatgatctcagctcacggcaacctccatctaccaagttcaagcgattctcctgcctcagcctcccaaatagctgggattacagtgcccgccactatgcatggctaatttttgtatttttagtagagatggggttttgccatgttgaccagactggtctcaaactcgtgacctcaggtgatccacctgcctcggcctcccaaagtgttgggattacaggtgtgagccaccacacctggccttttttgttttgttttttgttttgttttgagaacagagtctcgctctgtcgcccaggctgggtggagtgcagtggcactatctcagctcactccaacctccgcctcccgggttcaagagattctcctgcctcagcctcctgagtagctgggattacagacgtgtgctcccacctcacccggctaatttttgtatttttagtagagacggggtttcaccatgttggccaggctggtctcaaactcctgacctcacaaaatctgcctgcctcaggcctcccaaagtgctgggattacaggcctgagccaccacacctggccacaagaagccaccttaagaaaaaattgaaacagcaaatcattgtgtgaaagagatttacagtttttaatatttaaagggtcctgtaaatcaataaggaaaaacatgagagtggccagtaagcacatgaaaagctgctcatcaggaaaatacaagtgaaaactcaaaatatcaacaacactaagtatttgaaaggatatgcagcaattgaaagcctcgtacatgctactgggaaggtaaaatggtgcagccactgtggaaacttaggcattacctactaaagctgcatgtgtgccagttccactcctaagaaatgagtcctagaggccgggtgccgtggctcaacgcctgtaatcccagcactttgggaggccgaggtgggtggatcacctgaggtcaggagttcaagaccagcctgaccaacatggcaaaaccccatctctactaaaaatacaaaaattaaccgggcatggtggcgggcacctgtaatcccagctactcaggaggctgaggcaggagaatcacttgaacctgggaggtggaggttgcagtgagctgagatcgtgccactgcactccagcctgggtgacagagtcagactccatctcaaaaaaaaggaaatgagtcctagagtgttgctagcagcactatctatagtatatgcccattaaatcgtggtacattcaccgtggagaactgtacaacaatgacagtgaacatcctgcaattacaccaaataacaccttgtagttattcattaaactgaacatatataggttttatgcattttctatatgtcatggttcaccataaaaggaggaaatgtcacaaaaatgttagcagcagagttagctaggtgtggtggcacattcctgcctgtaatcccagctacttgggaggctgaggtgggaggatcacttgagcttgggaggttaaggttgtcgtgagctatgatggagctccactgcactccagcctgggtgacagagcaagaccctgtctctaaaaaaacaaaacaaaacaaaaaaactttctttgacttttggttagctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 2278 - DNA, 8374 bp, Homo sapiens
tgatactggccggcatcagtggactgtcggcaggtccttgagcaactggtgtgtgaaatgggacggacgtcaaaggacaagcgggatgtctactaccgcctggccaaggagaatggctggcgtgctcgcagcgccttcaaactgctacaactggataaggaattccaactcttccaaggtccctgactggtgggcaggtcactgggcggtgaggtgggcacaggaggtaaacaagtaggctgggtctgcagagctccctgtggtaggtgggctgactcagagggtctctggggcagggagacaggcaggaagataggcagaataccggagaggagttgggcacctgggcaatggagatatgtgggtgctccccaggggagaggggtgaattttgcaagggtctccaggttggagaagtgggtgcagctgatcaggatgctttcactatgtatgcccaggcgtgacacgggcagttgacctgtgtgcagccccaggcagctggagccaggtgctgagccagaagatcgggtaagtgtgggggtcccagatgggagacccaggagggccggctgggtgggaggggcccgggagcgaaactaggctgatgtgggccatgttgtccacaggggccaagggtccggccacgtggtggctgtggacctgcaggctatggctccactaccaggtgtggtacagatccagggggacatcacccaggtaagagcatggctgagggtgttggggtatatcctgggtgaaggcccttacctggggtctatgcagagtggaagagaaacagagaggtgatagaaacagagagagaaagagagtgagagagtaaccatggagaaacagtcagcaggtcatcattgcacagacacagcagaaaatgatgatgctgggtccccagaggtggagcccagtcttagagaggcaaagcctgggaatttggctgacccaggggctgtgggccaggaccatgggcaggcgggatctgagggcagcagtggagggccgtggggccactcatcctccctctctccatagctgtccactgccaaggagatcatccagcactttaagggctgccctgcggacctagtggtgtgtgacggggctcctgatggtaaatagcaacagaaagtgggaggccaggcggggccccctgtgtgtgtccttctctgtatctcccaccttggttgacttattcacctcttcagttactccctgcctctcccttccgcactcagctttctcccacatctggcaacttctccctacctctgctgcctgttctctctctgcctctctcttcctcccacttgcaccccaccctttgagtttcatgtctgttgtctacctttccctgctctcatctctctgcaactgtccaattccgttgcactgttcattcattttcagccagccagccattcaacacacatttactgagcacctattgtgttgggaaaacattcatgaataaaattccattaatctttaacctcatggagctgatgttctagtgggagcaaatgggaaagaaaataaatgattcagctctgtaccattaaaaggggatggggccaggcatggtggcttccacctgtaatcccagtgctttgggaggatgaggtgagaggaacacttgaggcaggagtttgagaccagccttgcaacatagcaagaccctgtcttaaaatattagctggcatggtgatgcatgcccatagtcccagttactcaggaggctgaggtgggaggatcacttgagcccaagaggtcgaggttacagtacactttgatcgcaccactgcactccagcctgggcaacagagtgagaccctctctctaaaaaaacggggtgaggaggccgggcacagtggctcacgcctgtaatcccagcactttgggaggctgaggtggtcagatcacctgaggtcaggagttcgagaccagcctgaccaatatgatgaaaccccatctctactaaaaatacaaaaattagccaggtgtggtggcatgtgcctgtaatcccagctacttgggaggctaagacagaagaatcgcttgaacccgggaggcggaggttgcagtgagctgagatcgcaccattgcactccagcctgagcaacaagagcgaaactccgtctcaaaaaaaaaaggtggggtgggggatgggtaccatagggaaatcattgagcaggaggaaagcaggagtacctgttggaattttaaatcaagtggatggggaaggcctcactgacttaacagcagagactaaaggaggtgggggagtaagctatggatatgtctggaggaagagcaatccaggaaaaattgcagcccgtgcaaaggtcctgaggcaggagggtgcttgctatgtatgagtaatgacaagcagatcactgtggttggaacagagtgagggggggagagtggtaaaaggtaacatcagagaggtaacaggggacagatcctatagggcctcgtgggccatggtgaggctgttggcattttcaccgagatgagagcttggagaaaaccatgagagggttgtgaggagaagaggactgtgctgggcttgggctactatgagctgtgtgagggccaagggcagaagcaggggctccggggtggagtagtccaggcaagtgataatgggtgagggcagtggtggagaggagaagatcaagtcagatcttttgaaagtagatgtgttaatggcttcgatgtgggtgtgaggagaggatgcggggggagcatcagaggtgactaaggttttggatttgaacaattagaaagctcagatgagatggggaggatggtgggaggagcaggtttggggaggtaggtcaggagtttggttgtggatgtattggagatgtagaatctgatttgtgaatctggagttcagaggaacagtctgggctggaggtggaaatgataatgatgcttgtgtgtgaggttgttttagaattgaaatgagttcctaagggttaggagctcagaatatgcatccagttggcagacagtaatttgcatctggaaccttagcagtaagacagcctggaaaatgtatttagtgtctgatctgtgtggtacaagaagatgcacagagccagatgggacccccctaacgctgttcctcttgccacagtaaccggtctccatgatgttgatgagtatatgcaggcccagctcctcctagctgtgagtaaccctggccacccctgacccactttggccccctcctggctgtctccacctcagcctcagccgtctgtcctgcccacaggctctgaacattgctacacatgtcctgaagccagggggctgctttgtggccaaggtaagtctcaaggaacttggtggagtagagggaggtcgctgagggccaccctcacccgctgtctttgccttctcaccctgcagatattccgaggccgggatgtgacgctcctctacagccagctgcaggtcttcttctccagcgtgctgtgtgccaagcccaggagcagccggaactctagcatcggtcagtggggtggaggggccaggcaggcagagggggatctctgggacgccgactgcacgaggaggaagcggcagtcatgcctcactccaccttcccctggcagaggccttcgctgtctgtcagggctatgaccctcccgagggcttcatcccggacctgagcaaacccctgctggaccattcttacggtgagagctggagcatgggccaccctgggggactctgccacaccttatgcaatctaggtcccatgagggcccacagtctcaccccctgggggaggctctgtcccctcatgggaatttttttcccaaggggatccttagccccattctctgatggaaatcccacccctttatgggtattttgtcccgggaggagcttcagcccaggcagtcctctagtggtaactcttgggcctggtgaaaattccatcccaggaggatcctgagccctgccccagtggagactccacctgcctaaggacattctctcctaggaagatctcagtcatgtcccaggtggaaacctcctcggtgtgaaacttttgccccttaagcctctagcaggaagagacagagcctgcccctgggatgacatttgagtgagggagacgtcatccaggcagcatataatccaatatcaggtggacataaatgcagtgaaaaatagcagggcaccgatgttttagaaggggtgattatggagggcctccccgaggaggtgatctgaaccaaatgaaggatttctggtggggtgggaagagagtagctggtggatatgtggggagggtttggcagccataccgccgcctgtgtcatgactggccccaggcatcctgaccttgtcctcagttgtctccccctgttcctaagacccagatttcaaccagctggatggtcccacccgcatcattgtgccttttgtgacctgtggggacctgagctcctatgattcggaccgcagttacccactggacgtgagtgcccaaccaacagtaggtgggtgggagggaggctgtcctaggttaccaggtcctcaccatctccctacccctctgtccctgcagctagagggcggctcagagtacaagtacactccacccacacagccccccatctcgccaccataccaggaggcctgcacgttgaagaggaaggggcagctggccaaggagatccgcccccaggactgccccatcagcagagtggacacgtttccccagcccctggccgcccctcagtgccacaccctgctggcccctgaggtctggaaatgtgactctcagcctgccttgaccccttccccgtgtgcctttttctgacccaaatctcatggtttctggggccaaaattccctttcctgcctcccaatagctataaaaaattggtaaagccaagcataatgaatggaaaagtttcgccaaatatgtgagtcacttttctttttcttgggtagatggaagacaatgaaatgagttgttcaccttaacccattacggtaagtttgccttgttatctaagagtttgagtaagggcaacctttatgaaaaacctcagtaaaatttcacctttgaaatttttatgtcaactgataagattttaatcaacaaacccttttctaaacatctgttgttgtatgccaggaactgctttaagcattttacatttgaggcattcagtaaacatttattgagcacatactgtatgtcaggtgttgttctaggtttggagatagagcagggagcaaaacagaaatatcttggctctcacagtacttccagtttggaaaagaggcaacaatcaaaacagtctgtaagtgcaagagtttacatacacatatatactatatagcttgcatttctcaatttacatatcttgcaatatatataatatataagagtaatatgggatataaaaaatagaaaaaagtaaagcagggtgaagagaatcaggaattctaggcatggcagttttcatcttttggtgtttttgttttgagacaaggtctcactctgtcgcccaggctggagttcagtggtgtgatttcccgggctcaaaaaatcctcccacctcagcctctcaagtagctgggactacaggcatgtaccaccatgcctagcaaatttttgtatttttaggggagatggagttttgccatgttgcccaggctggtctcgatctactgggctcgagcgatctgccatcctcggcctcccaaagtaccaggattacaggcatgagccactgcgcccagccagtttgcactttttaaaagggttgtcatagaaggcctcagacattcctcagaggtaatgtttgagcaaagacctgaaggcactgccggagggaagccatgtgtttatctgagggaagagcattctgggtaaaggaaataggcatgtcccaaaggtggaactgcacgtggtatgggaggaaagtttatccatagccaaatgttctaaaaccacgatgttagaggatggccctttctgacaatggcatagcaggttattcagactaagtcagccatcacaaaaagccacctttttttttttcttgagacagagtcttactctgttacccaggctggagtgcagtggcatgatctcagctcacggcaacctccatctaccaagttcaagcgattctcctgcctcagcctcccaaatagctgggattacagtgcccgccactatgcatggctaatttttgtatttttagtagagatggggttttgccatgttgaccagactggtctcaaactcgtgacctcaggtgatccacctgcctcggcctcccaaagtgttgggattacaggtgtgagccaccacacctggccttttttgttttgttttttgttttgttttgagaacagagtctcgctctgtcgcccaggctgggtggagtgcagtggcactatctcagctcactccaacctccgcctcccgggttcaagagattctcctgcctcagcctcctgagtagctgggattacagacgtgtgctcccacctcacccggctaatttttgtatttttagtagagacggggtttcaccatgttggccaggctggtctcaaactcctgacctcacaaaatctgcctgcctcaggcctcccaaagtgctgggattacaggcctgagccaccacacctggccacaagaagccaccttaagaaaaaattgaaacagcaaatcattgtgtgaaagagatttacagtttttaatatttaaagggtcctgtaaatcaataaggaaaaacatgagagtggccagtaagcacatgaaaagctgctcatcaggaaaatacaagtgaaaactcaaaatatcaacaacactaagtatttgaaaggatatgcagcaattgaaagcctcgtacatgctactgggaaggtaaaatggtgcagccactgtggaaacttaggcattacctactaaagctgcatgtgtgccagttccactcctaagaaatgagtcctagaggccgggtgccgtggctcaacgcctgtaatcccagcactttgggaggccgaggtgggtggatcacctgaggtcaggagttcaagaccagcctgaccaacatggcaaaaccccatctctactaaaaatacaaaaattaaccgggcatggtggcgggcacctgtaatcccagctactcaggaggctgaggcaggagaatcacttgaacctgggaggtggaggttgcagtgagctgagatcgtgccactgcactccagcctgggtgacagagtcagactccatctcaaaaaaaaggaaatgagtcctagagtgttgctagcagcactatctatagtatatgcccattaaatcgtggtacattcaccgtggagaactgtacaacaatgacagtgaacatcctgcaattacaccaaataacaccttgtagttattcattaaactgaacatatataggttttatgcattttctatatgtcatggttcaccataaaaggaggaaatgtcacaaaaatgttagcagcagagttagctaggtgtggtggcacattcctgcctgtaatcccagctacttgggaggctgaggtgggaggatcacttgagcttgggaggttaaggttgtcgtgagctatgatggagctccactgcactccagcctgggtgacagagcaagaccctgtctctaaaaaaacaaaacaaaacaaaaaaactttctttgacttttggttagctggcaaactgatacaactcagaaactgctcaatgtcaggaaaaccggaacttgttgatgaacttgttttcaaaatatcatctcatcaacgaggcctggacaaacaagccctgaggagggatctgcaacaaccctgaagacaacaaggaaagaaaccatgaaagtctgtctgtactgcagtgggaattcttgagtgaggtcttacctcttctttaaacctcttcaggagtgtcctgattatgtccagaattttccctaaaggcagggattcttaacctggatagaagccaggggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaattttgtttcaatttaatatatagtaataattgtaattcaatgtaattggcttccattgt

SEQ ID NO: 2279 - DNA, 10205 bp, Homo sapiens; identical to SEQ ID NO: 2277

SEQ ID NO: 2280 - DNA, 11719 bp, Homo sapiens
gtggtagctcaacatctttatttttcctctttagcccgagggtaatcctgacaaacagcttcagccaggaggaggcagagaggactgggctgggcaaaggctccaccaggacctggcctcctcctcctcctcctcctcctcctcctcctcctcctcttcttcctcctcctcctcctcccatggggttggggttgggattagggccatgatccaagcttggcatccctggggaggagggaagtgggccagtctgcagcctctgctgtcccccgcctctgacaaccacgttcatgggaaccagccacctccacatgttgggcaggagggaccctagggagcggccctgacccctccatgtgcatgcgcacagggacctgggccagcagggcctgatcagtgtccagacatgcggctctggcctgtggcccagttggcaaacataaagcctagactgacggccatgaagaggactcccaggactccaaagcacagggcctgtgggccagagagacaagatggggctggttgggactcctcacccagttgccttctgagaatgttcctcaagtcttccacctccttcagagagtgctccatccattcctgaccctcctctgtatgccctctccttccttacagccagcccctttctgcgagtccttccaccttcccaggacccatgacagaatacgttcctccatcctccttcttcaaagtgcttccagctctcttcccaatagtgctctttccatctgtctggagaatgctccctctatgccagcctctgtttgagtgctccctgtcttcctggaccctgctggtgctctgtctcctctgccccttcctagacaatcaccttcattcttccagaccattctttcagatgctctcccagccccctcctatgcatgtccctttcacctccagccatcctggagtgagcactccctccttggagtgctccctctctccctagctctgccctggaatgcttacctggatcttgggccaggataagaaaggctccacctcagagggtacaatgcggaggtagaagatgctggggaggatgaagatgaggctgggggctgaggtggaccctggagaacaagaagaagggacaggagtcaacctgacttggggacaaggcccatattagatggggtatgggactggggtgaggtttactgaccgataactccaaagatatcccggatggttggcacacagatgacaaggacattgaccaaaacaagcaggatcagagctatggccacatgtcgtggccagctgaaggccttgcctgggaaaagcagctgctgcagggcccggcggatctgtggccagagtagggtgggacagaagtcaggacccaagtgctgccccccttccacgtgatcatctgtctttagctccaccctctggctgagatccctgatttcccctccctctgactatctatggctccaccctgcctaacccaacatctgtgtctctatgttctgaacaggcttcctgcctccatcctctgacaatccacgtctcttccttctgtctgaacacccatcggcacctgcacccactgtctgaaatccttgcctcctcctctagctgaccatctttgccttctccttctgtctgaccatccaccgatccttccaccctgtgtgagctccctgcctctctccatctgacctctacctccctcctctgtctaattagttctgcctccccatctgggagacttgaccctcctacatcccatcacttcagcctccaccctttttctgtccatccctgtttcttaattctaccctccaactgacccttcctgcctccctcttctttctagccatccatctgtgcctcctccctccaactgactaccctgtcccctgaccctctctctcctgctatctatgtcctccccacttctgtttatcgatttttgccatctctgtccatctgaaaacactgccctttcctgtctgtccatccttgcctccttcatccatccatccactcctgtttccagccttgacccacacatccatgcctatgccctctacccatccatccatgtccctctcagccgtgggccccacgcacagggaacagcacgactggcacagtgagggtcaccgcgagcagcacggccaggcgcacacagaggatgagcgggtccttctggctgtacatgtgcagcatctccgccttcacactgcctgggccatgagacagagggtacgggatgcaggatgtggagagagcaccaggaccaatgccccagaaacccatacatacatgcacagtgacaaaatccacacaagtgaggcacaccttctgtttggaaactgacaggtccgtggtcacagaaggaaagagctcagaggctcctgccccaggccttccccctccccccagccctagccccagccccactcactgtagaaggtgaggtatccaaaggttgctgtgagcccatacatgcagaacatggccccaatggacacgttggccacggcctgcatcctgcgcttggagggcctgaggtgtagaggtcgtggaactgtcatgcccagaccctgagacttgccccaggtccctcaaagccagcctccaccctccagagtccccttctcccagactgccattcagctggcacacatggggacacccgtctctgcctcccctgtgactagccaaaatcccctctctgaccatccatatctcccccgatatgactgtctccctctcccctgcgtttgactgccactgcctcttccatctgaccatccatgctgtccctctgtctgatcatccacacatctcccatcatatcatccctgcctccgcctctgtctgtccgtacctccctatccccatatcaccagccatgcatatcaccccctccatctgatcatctgatctctgcttcccaactctgtccatccacatttgtgctggatattaaaataggagaatacttaagccccaatcagcaaacagtcactaccctgagtgccccaagacctcctggccaccccaaacccctcccatgacacaacctagcttccaccaagtgacagtcccaggactgctgtagggagtgtcagacattctggttaccaccccacttgctggcccatcattcaggcccacttgcctgcccactcaccggcagagctccgtatagatgggcagcacctcagggtggcagacaaaagcaaaagccataatgggcactgtgtaggacatctaggggaatgcccgagtacatgggattagagccaacaggggtccatccccttcttcccatccccctcccgccccgtaatcgccctccatatcagacacatagaagctcccaatgtccaatatccagctccactctgagcaggatgcaccatatgacagaaccagagggcctgagtgtgatgcaatctcctacatgcctgcacacacacctgtgagtcaactgtgaacatctgggcctcacagctgctgttgagtccttggctggggagtcccacgagagcttcactctccattgctgtttcattgtggcctatagcacagccaagttggaacttcttgtagatgacctgaggatgggggcagcagggaagccaggtcatggaggaagctatgtcccaatgtcccaaactctctccccgcttctctgtgactcaccgaaacaaggaaaaacagcatgcaggtcagagagagaccactggtgtaccccaggtagcctaagaggggcaaaacacagagtctcagaaatcagccaggcgtggtggctcacacctataatcctagcgctttgggaggcctaagcgggtggatcacctgaggtcaggagttcgagaccagcctggccaacatggcaaagccccatctctactaaaaatacaaaaattagctgggtgtggtggcgcatacacctgtaatcccagctactcgggaggctgaggcaggagaatcgcttgaaccgggaggcagaggttgcagtgagccaagaccacgccattgcaccactccagcctgggtgacagagtgagactcggtctcaaaaaaacaaaacaaaacaaaaaatcaatggacccccggaacagtgaactccaaacacctagtctagccttcaaggtctacccaccccagttacctttgcataagcttctacttccacccagaaaaacctcccctccatagcaaactcctactaatctgttcaagcccacatcaaataagctctctcctagtgtgctgcagcccttgaaaatgaatgggggttttctcagtctggcttcttctgtctaatcccactacccaatggccaacccagggagcctcttacccaagtgtttcatgagggcgaggggcaggatgattaacacactgacgatgatgatgaggaggtttcccttcaagaaccagtccctagagagacaggaagacacagtgcctagctgccagccaaaggaaactgtcaggcagacactcacagaagacagctggacaggcagctttctgccctaagtcaggagagttaagctgacaacctcagcttgagaagtcattcaggtggtcacagtgacaaacggcacaatagggttgacaaaaacagtcaagctgattatgagattgtcagatactatcagtgggacacagctaacacatacacagctggacaaaacttgccatcagacttcgcaagtggttgcacaaccagaaggtcaaacaccccaaatcagtcagactcaatgtaaaaatcagtccaggccaggtgtggtggctcacgcctgtaatcccagcactttgggaggctgaggcgggtggatcacctaaggtcaggagtttgagaccagcctggccaacatggtgaaaccctgtctctactaaaaatacaaaacaaattagccaggcgtggtggggagtgcctgtagtcccagctactcaggaggctaaggcaggagaatggcatgaacccgggaggtggagcttgcagtgagccgagatcacgccactgcactccagcctgggcgacaaagggagactctgtctcaaaaaaataaataaatagataaatagccaggtatggtggcgcgtgcctgtaatcccagctactcgcgaggctgaggcaggagaatcacttgaacccaggaggcagaggttgcagtgagccaagatcgcgccattgcactccagcctgggtgacagatcaagacactcaaaaaaaaaaaaaaaaaggaagaaagaaagaaaaaaaagaaggaagggaggaaagaaagagaaaggaagaaagaaagagagagaaagaaagaaagaaagaaagaaagaaagaaagaaagaaagaaagaaagaaagaaagagaaagaaagaaaggagaaaatcagtgcaacacaaggtgccagacacaaagagagtgagtcacgatcgtggtatgtctgacaggtagagcaacagtctgatgatccagtagacaagccacgatgcagagtccatcaaaaagtcagaaacacacatgcatgcttgtttgaacagctcaaggtttgttggatgcctgaaagtatgcctgtggactgatttggctgcacagccaaagaaagactgaaatagaaacgaaatcatccagctggccacactgttggaaccaagctctgagaaaaggtgggatctgtacagatattggaggaaggtgaccaggcaagacagtcagttaagacagaatcagctgaacaactgctcatgcattcaaaacaacttgattgaatgcctatgttctagacattcacatggtctctttctatctcatatacagttacacagaaataaaccaatgggagctaactataataatgagacatctctggtcacactatcagctatctagtgttctcagaatcaaaccaaaaatctaaaaggatacacacagagagtaaagatcaagcactcagttaaaattgtcagactggccgggtgtggtggctcatgcctataatcccagcactttgggaggccaaggcaagcagatcacctgaggtcaggagttcaagaccagcctggccaacatggcaaaaccccgtctctactaaaaatacaaaaattagccgagcatgggggctgaggcagaaggatggcttgaacctgggaggtggaggttgcagtgagccaagatggcgccactgcactccagcctgggcaacagagtaagactctgtctcaaaaaaataaaattaaaaaattaaccgagcatggtggtgcatgcctgtaatcccacctactcaggaggctgaggaaggagaatcgcttgaacctgggaggcagaggttacagtgagctgagatcgtgtcactgcactccagcctgggcgacagaatgagactctgtcaaaaaaaaaaaaaaactgtcacacagaccagagtcagactgacaaaaccagagacacatctacacaccatgcaaagcccatgggaccagaggcagagttagcccatgggaccagaggcagagttagccactggacacacagagctgttcatgaaacacacagaggcagctacacacgtgcagctggagcacaagcactgcaacacactgtgcatacacactagccctgctggagtcccatcgtgcacatgccccccacacataccaagccagcacagcggatccggactcacacacagtcagccagatgcataatcagaacagtccagcatatatggttgcaaccataatacagaggacacatagccacattcagggatcacacacacacacacacacacacacaccagagagaatttgccagaacagccaccaaatcaaacacagagatggagttggctggacacgtacagtcagagtgagtcacacatagttggtaccacagcatactacgtgcacacagacacactgctggagtcagcgatcacacactcacagctagacggagtcagtgatcacacactcacagctagacagattcagccagatgaacctagaatcaagctcaaacaatcagctggacaggggaagtcagagtgaccgagggtaagacacatatggttggaatcccagtatacgggacacagctgtagtcaatcacagagctagcccaagagaatcagccaggacagcagacgcagagtcaaacccacaggcagagtctgagtccattggctatgtacattcacacacacatggtcagcagcagagtaaaccggacataaagagtcagcctccagccagaagcagccagaataagtcacaaaatcagcacacggtcgactggactcctgtggtcagagcaacaggcacacagaggaatcagtctgacccaagtggcctgcccagcagtctcaaactagaacatctggaagtcagctgcacacacagcgctgaagatactgaccgggcctcacaggcagagtcaaggggctgctggccagccaaggggtgttgctcactcacccctcggggtccatgtacaggaaggtgccgataaccagggggagctcagatttgatgatgaacaggtaactggacatggctggtgcaggtgggggaggtgtaagcagaaggattctcttcatgcccccaccccgtcttccccagcccagcctggggaagcccacctcactccgccctctccccccaagctgacccccacctcccagagtcctcacccccaacattgtgcagacagatgactgtggccaccactaccttccccgcaggcccgaatgccctctgtcccagctgctcataggctcggatgcctagcggggggagtcaggaacagggttgaaggtccaggaggccaggccagaggtgcaggccagagggcccaggagctggggagttggggcttgggggaaccggctttgactgatggaggatgaaggtgggggttaagcagttgggcttgagtttgggggcagagtctgggaggtgggatctgaggccagggaaaaggatgagggctggaggtaagagtaggggtcttggagccagactatgaactgagaccatggtaggagctggggaaccggggactgaggggtgggggttagaggtagagtgtagtggtctgggggtgggttctggggtgctgggtccgggatctggggtctgcattcagggagctgggtctggggtctggggtccaaggtctgtgttgagctctggatgtggctccagagtctggggtccaaaggggtggagtggggactgggatccaggctctgggtctcacctgcaataccagcacaggtcagcaggaggtggatggagtaggacgacagaagcgcaatgcacagcagcagggccctgcggcaggtggcacagctcagacctggccccaggcctcccacctgccccacaacacccctggccccgcaggccacctatggactcacaggaagaagatgacccccgtgtgggccatggcataggccagccccaggatgccgctgcccatgatggcgttgctgaggttgaacactgacattccaaacgatgtcttcccctcgaactgcacgcaaggagcaaagcccgggcacacattgggacagggcacagggtaaggagactaatgccagggccagggaaagactagagaagaagcaagcggggtggagagaagccaaggagagaccatcggaggagggaagaggctagcagggaagaagagttgaagatggaagaggctgcgaatggggagagctgggaagggggaaactaggacaaactttggagggagcagctggaagtggagaggaccgggggagggtgaagcagccaccagaggtaaaacagctggggaggggagacgctgcgggtggggataggctgaggatggggagtgctggaggaggaagaacagctggaggagaaaggcaggccgggaggggagcagccagggagggcagtcactgggccgaagagcgggtggggagaaacaaggccagggagagagctggaaagggcatatctggggaagaggagtatctggagaggggagcgaccaagtagtgtgtagctgtgctggggagatagctgggcaggggaacagcagggaggaggaggagtggggaagagggagcagtgcgggaggagattagctggggaaggtgccaccaggacagatcctgtggggccactcacatccatgaactggaccggcttgctcccaggagcaggaccacgactgggcaggaagccctcacgttcttgcctgtagctggatagggcagggaaataggggccgataagagggaaatcctaacccctgatccctgagcccacctccttggacccctgactcaccccacagcatccgaagggagggctccattcatctttggatcctgcagttccatcctgtgggcaaagaaatggggtggggggatcagagatggaacgagcatgcttcaaagtgaggggagctgaagaaggggggaggggagtcccatagagaccgatggaaagacggagaaagagacaaggcaggggagcaggaacagacagggatagaaatggaggcagactgacagagaaagagatgagagagagagaagaacaaaaatcagagaaggagagaagccaacagttagttactcagagagacacagagagagccagtgagagagaaatagtggggaagagagagacagaaagctacagagagagccggaccccagcgcagatgagccgaccacgtggagaagggatagcctctcctcccagaccccagactcacgctgtctctcttgccatctgtgtctttcattccccggtcccccgcgccaccccctctccttccctccaccctcaccgcgtggccaggcggctcactccttgcagggacacgtgtcggcctggctgccccacccctcctaatgccctcacccccctccttcccgcctgggcccccaagcccgagaccagagctaatgcaacctgttgagtgagctgagggttggggacagactcggagacccctgccccagacgctgcaaactgctctctgccacgactctgaatatcctcactagaagccaaagacaagtgcccgaaccgagccccttcccagggacagaaatgacccagggactcccatttgaccccaattctagggcctagaggtcttttccagggcccctagcaagtcttaaacactcatcttctggcagaagtcaatttggagacactgccagacttgagaaacttcctaggtgtggggtgtggggtgtctcaggaacctggcccgagccctcatttcccctccggaggaagagctatttctgagaccttcatcaaagaccccctcccgtggcctaccgagtttcctggggtgggggtgtctctgcaatccccacccgagcctggagcccctgtcttgtaggtacagcgtctctgaagaaaccccagctccctcccgcgcttactccttgggaaggaggtatctcagaaacccccattcaaggtccccattagagctcaaactggctcaggaaatccttttcccaagtcctgaatcccgttcctgggacagggagggtctcaaggagtcccatcccccaccaccagcaccctccggagcctcccacccacacctgaattcacttcctgggatcagggtacaaaaaggacctccccatacacgccattccattccccactagtgctaaaatgtctccaaggaaccccgagccccctcccaggacccctactcatatctcaggcccccaggaacaccatccccgcagcccacgctccctcctcacctacctgctcctctcagctcctgaagtggccgcaactcagactcaggttcgggcaccctctcggctgcctaggctcctgctctggagcggtacttttttttttttcctgagaagaaatgttaattttaatttcgtttccctccttctggccctgggcgggggaagaggtggagaaggggcgccccctatctggacccacttggagggagacagcggtttgtttgtgtgttgatggtgggggaaatggcctgaaagattgagggtgtagacccacagctagagagagtgacaggcagacagaggggatggactcacagagcagacggacagcaggatgggatggatggcagaaaaaggtgcagagaggagacagagagagagtaggagaactgaagttacaaagaaagcaggcatgagaaacagcacaggaacagacagaccacagaagggacagaaagacagatgggcgggaggaggggatgctaggggagcttggaagacaggcagagacagggagaaagggacacacaggcagactcagaaacaaacaggtgggtagggataggctcgtggaaacacctgcagaaaggcaacaggcaattgggctcagtcatagacaggagacacaggctggccaagaggtgggggacagagccagacagctccccaaacagagggtaggaccagacacaccagctcagagagatgaaggggcagagagagtggttgaggcagagagactcctggagggacaggagaaaagaggcagagagaggcagattcaggcagagaggcctggggacagcaggggaacaggtgcaggggtagtagccaggctattccaggcagacctcaggcagacagcctaggcacgagaggaccctagatcttgggggcccccagagggaggcagggagggcatttgt

SEQ ID NO: 2281 - DNA, 6814 bp, Homo sapiens
agaacactgctcccttcgctttgctgtcccttcctctccccaccactccgctcctgctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggtaagttgcatatgtcctgcgaaacggcggctcctcgccacacacgcgccgcgccggccgtgaccggggaatagcgagtggggagagtaatggccactgacacgtaggcttggctttctctgggacgggcgggtcccgtgcttggaggtgaaacatttcggttggtgggaggccggcgcgctgtatctgagtgtgaggcctaccgggagggactggtggcgtcggtggtggcagtgaccacgcgacagccgacacttactttccttatcccacgtggccgccgccatcttgttctgccggcgttaagggaacgcagggatgttctgggcttgcgcagtggcacaaaatgacgggcgtggcggctatgaatgtgagagcatgcgcaatgtggccccctaatggtggctgcgctgagccagctcctcagattaccaccttattggccgcctttctcagcttttctgtagttacccatattttgttcctctttcttgtctattttctgtgctttttctctgctttccgtctcgctattttctcacatctccattttctttctccttcctgccaccattcttcatgttcttcccacaggacttgaactgccatgtcctctgaagaaggaaagctcttcgtgggagggctcaactttaacaccgacgagcaggcactggaagaccacttcagcagtttcggacctatctctgagggtgagacgggccatactcacaatgggggttggtgagagaaagtctgggatccttgcatttcaaggagtattaactgaaaagttaggacccacgcctccaaattctttttcttcctaagcctatggtgtagactaaggatgaggggaagcgtctttgggattagtgggagcgctccgttttccctacctatgccatctccttttccggccaccctttgctacttaacctttggggtactgactggtccacattgctccatcttctctccctctcacagtggtcgttgtcaaggaccgggagactcagcggtccaggggttttggtttcatcaccttcaccaacccagagcatgcttcagttgccatgagagccatgaacggagaggtggggcctcctatctgcagagggaccttgtccccatctgcggcttccttcattctttttgtttttccctctgtgtctgctcggggcagcgtggccaccaagccccgcagtgcccactcacaggagcatgactgccttttgttctagggggtggagggcagcggcagacagagcctggccgcctgggaggcgacgactggtcctgcatgaggccgagaagccacctgtggatggttgacctgccttgggcttaggtagtagagtctgcagacctgtgggcctggcccggagaggacctcgtgagtcttctgacatggactctgaagcctcaaaccaagagaggtgtctgtctagccctgatagtcgggcagcttagaggagtggggaggagaactcagcctgagttcagtcaagatgtaagtagtagcaaggggaacatggtgcattcaggtcattttgtgtgggattctatagctcctgatgaagccattctggggtaaaggagcttattctggaacatggcacccagaacctggtgcccagcaggaatttttggcctcttttgcccacttacccttgcctgctcttccctcaccattgccctgactgactgccaacccatcatccttgtgtctcccacacttagtctctggatggtcgtcagatccgtgtggatcatgcaggcaagtctgctcggggaaccagaggaggtggctttggggcccatgggcgtggtcgcagctactctagaggtgagtgcagtgatcgttttgatcatggggtgagagggagagttgcctatgtgtggacaactgccatttaaatatttttctgctctaggtggtggggaccagggctatgggagtggcaggtattatgacagtcgacctggagggtatggatatggatatggacgttccagagactataatggcaggtgggtagccaaagggctgggatgttctcctattgcttccctctccttaagaactcagcgcctgggtgttcatgcataccacaccttgctgttactaatgtgtacctaaaatgagtatgaaatttagcattttaagttaattgtgtagtcatatagttgcgacatggtaaagtatactatatatgttgtgctgtgtgggttatataactatattgctttaacatgtaatatgatttaatatactgcgtataaatcgtatgccataaaactgtttactgtgatactcatatgcttaacatatcctgtttttgatacgtaaggtttatgttatgacccatactgtaaaatgtgacgcatataattacagtggtatatataatgcagtaccagaaaacttttgtgtgttttttttcccccccagaaaccagggtggttatgaccgctactcaggaggaaattacagagacaattatgacaactgaaatgagacatgcacataatataggtgagacttggatatcggcattgagtgaacctgtttgtcacactctgtcatgaccctctcaccttttctggcaagactgctctgcatttctgctgccctcatacctcacccagccaacctaccaaacattcctagctaggccttccttgctctcaggtgcatatcagagcaagtttgctagggggtgggatctgaaaacccatctcctataatcttctactcttgtgtgggatggaggaaatgaaggtgtgtccctgttgtccaaccctcagcatcttcatcagctctaggaggtgagcatgttgtcagctgttacttcatgacatcacaattctccccctcttgctgttcccagatacacaaggaataatttctgatccaggatcgtccttccaaatggctgtatttataaaggtttttggagctgcaccgaagcatcttattttatagtatatcaaccttttgtttttaaattgacctgccaaggtagctgaagaccttttagacagttccatctttttttttaaattttttctgcctatttaaagacaaattatgggacgtttgtagaacctgagtatttttctttttaccagttttttagtttgagctcttaggtttattggagctagcaataattggttctggcaagtttggccagactgacttcaaaaaattaatgtgtatccagggacattttaaaaacctgtacacagtgtttattgtggttaggaagcaatttcccaatgtacctataagaaatgtgcatcaagccagcctgaccaacatggtgaaaccccatctgtactaaacataaaaaaattagcctggcatggtggtgtacgcctgtaatcccagtgacttgggaggctgaggcaggagaatcgcttgaacccgggaggcggaggttgcagtgagctaagatcgcgccactgtactccagcctgggcaacagcgagactccatctcaaaaaaaaaggaaatgtgtatcaagaacatgattatccagcggtattttctaattcagatcatcaaactgattatatagaagagttggctttaaaatgtttgcaaatgtctttttttttttaatactggaagaaaaaatattctgttgtgtctcatacagtgcttaggatgtctttcacagagcttattaaaaagatgaaacctgagaacaaactgctttattcttactcagcccattttgcaaattaaaagtgggggcagaggtgggcggatcacctgaggtcaggagttcgagaccagcctggccaacagggcaaaaccccatctctactaaaaatacaaaagttagcggggcgtggtggcgggtgcatgtaatcccagctactcgggaggctgaggcaggagaattgcttgaacccaggaggcggaagttgcagtgagctgagattgtgccactgcactccagcctaggtgacagcaagactctgtctcaaaaaaaaaaaaatggcacatcaacgagagggaggcttggagaatatttggttggtgggtgggcagggactgccagagggttaggtgtacattgaggcctgaggcctgctggaattgggtttccttaactggtctcttatcttagtcccattgttctgagaacataagcacctaatctcatggcgtgagctaatccctatcataaatagtggtaccagttcattccttcccctgaaatgatgggggttgggcagagatgcactgaactcatctttgtgtatgagggccatgagagaggcctggtttgaaaacaatgctaagagctcagattccaggatttatgtaggggctcttctacttcccaggtatttgacctcaggtgagtcatttaatttcagccttatgccattttacattttctgtggagggttaggttaattggcatataaagccactgagaagagttggcaaagctctcagtcacggggatttgatcttttttggtgtgtgtgtgtcttgggtggtaaagtggtaattttgtaattctagctggtcttagttcctcagttctgctccctttagtcatggttctttctagtggctgtattgaggccccatgggtgttatccctccattggttctagtttggaacagaaaaatctgttgtattcatggctttcacctggctaatactgagctaagttaccaccaggttgcaaactccaggacattattgtcctgagctgcctattcccttgctggtgcgttgtggaaccctgtattattagttccagtcctggaggcctgcctcctgagtttcccagctagttgggacaggccccaatatcccttcttcctgtaacccaaacagtcatgaatttgctttggcaggtggatggagacttgggaacttccacctcacccactaagccaggcccaggctatggggcattgtggctaaccccaccaggtggatacttggtctgaggacgcatcttattctgggcctttagggagctaaggcagtgagaattggcaggaggactgctgtgaatgccttgtaggtcgggggattggagggggtcctctgctccctgtctctcaggatggcaatgtacctctcacccccagtgtcagctgaggtaggatccataatcagtaatattcctgcaacaaaatgttcctaagtggaatcaatgaagaccaaaatttatttgtataacaactctaaacctgctctgctctgctgtgtttacaatgtgctttgtgatcatccagcccagggagtcccagtctctggctgtctatctgctctaaggaagagagcccacagttctctatagtgccatagtctgtgatgaataaagttccagatttgaggtcaacccccgaccacccttaaagtgcttgttggtctcctactttggtttgtcttcagcatccaactgatgcacatttgtcaagaacccactgaggctagaaaccccccaaacactcaaggtaccttgagaacatgtatcccaagacctgcaaagaccaaacacatggcctgtaactacttttcactttcaagccctggaacttgtctgtaccaaaaatctttctgaaccattcaccaaatctcttgtcaagggccagaataaattaagagattggcttttggttttcaattaggctttcaagtcctaagcccaacccctcctatcccacctaggcagaaatcacttcagatccttgcttcctagtttaatttcttctctgcctcagttataacatccataaaatggaaataataatacccacctcacacaggggttaggagtgtttttttgttggtttttttccagacagggtctcactctgtctcccaggctggagtgcagtggcacaatctcggctcactgtaccctccgcctcccaggttcaagcagttctcatgcctcagcctcccaagtagctgggattacaggtgcctgccaccacgcccggctaatttttgtattaatagagacagggtttcaccgtgttgggcaggctggtcctgaactcctgacctcaagtgatccacccgcctcggcctcccaaagtgctgggattacaggcgtgagccaccacacctggcctaggagttaagagtattaaatgttaagaacagaccaagtccatcaaacagctccacacccttgttccatgttctggattggggagttgtgggggtggaggtgtagaacttttaaaaagcttcttaaaataagttgctgtgaatacttcaggtatataaaaaaacattggttgacaataagccagtgttctgccattcttacctgcttatcaagacaaaacctgctcaagtccctgcccagctgcattccaagtgttttcaagtttggtggtaagacctgacctgaggcttcttataacctttactcagtgggaatatgcatacagttcactacagaaatatttgtatttacttagaggaagtgccctggatctgggggcgggggggggcggggggaatgggtcttttctaaattgttaaaagcagttcatgccattattcttaataaacatttctaatatgctgtgaaagag

SEQ ID NO: 2282 - DNA, 7360 bp, Homo sapiens
ggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtgggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctttgctgaggccactgttcctcatgcagtggggccccagccccaggcacacacgtcagagccttttagagagaaaagtgcccagtgagtgtgcagattcccactaatggcttcttggcattgcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccactcaccaagggctggtgggctgggtcaggaaggctatctgagggaatcagagtataaggagggacagccagggggggcctaggacccccccaccccccacccaatctcgtcagagcagtcctagtgtggtcagacttaaaagggaagcagatcagaagacgggagtgggccaggcgcagtggctcacgcctgtaatcccagcactttgggaggcggaggcgggcggatcacgaggtcaggagattgagaccatcctggctaacacggtgaaaccccatctctactaaaaatacaaaaaattagccgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttgatctgggttggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatcaggttaatttaattgagggagcagtagtagcagtaacagtaatagcagtagtgagcgcgtttacagccatcactgtggccaggccctgttcgaagcagtttccacgtatcaccacattcaatccttgcaccgacctgtgaggtaggtgctgttattatctccattttgcaggtgagcaaactgaagcataaaatagattagggctacttaaagcagagacctgttttcctttcttccttccttcctttttttttttttttttttgcggggagtagtgtgggggttactgtccccactcacatctgtcatgttacccaaatgcagttctcagcctgggccacacattggaatgacctgaagagcttcaaaaactcctgtctgggcccctctacaggccagtaatttcagaagctttgggatgggcctgggcattggtagattgagaaattccctaagcaatgtctggccagtcctgaaaaccactgcctaacaggatgctttttattctacccctttatttctctcctcctttttaaacaatttctgtatatatacttaacaattttttaatttaagcgtacccttaagtttgcccatttcccacagcctctcctttcttcctcctgccacctctggcctcctcctgccacagtaaagcccattaatgatccacatctttccacatatccttctctttccacaaatcctaggcgtgtacatatatccatgtatgtttttgtttgtttgtgagacagggttttgctgttacccagattggagtgcagtggcatgatcatggctcactgcaacctccaactcctgggctcatgcgattctcccacctcagcctaagtagctgagattacaggcacacgccaccatgctcggccaacctttttaatctattttttgtagagatgaggttttgctgtgttactcagtctggtcttaaactcttggcctcaagtgatccttgtaccttggcctcccaaagtgctgggattacagacgtgagccaccttgcctagctcccaccacagttttgaaagaaagacgttttaaagaaatggccttttccggccaggcacagtggcgcactcctgtaatctcagcactttgggaggccaaggcgggtggatcacctgaggtcaggagttcaagaccagcctggccaacatggtgaatccccgtctctactaaaaatacaaaaattagctgggcatggtggcaggcgcctataatcccagctacttgggaggctgaggctggagaattgcttgaacttgggaggcggaggttgcagcgaggcgagatcgtgccattgcactccagcctgggtgacagagccagactccatctcttaaaaaaagaaagaaaaaagaaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaaaacaaaaaaaaaaatatgggtttcatgaaccctgtaaagaacttaggcacaggggtggggacacaggcccacaacttgtctccctgctagggctggggctgtgttttgacccactctctcatcctctcagggtggtagacaacgaggggaccctgcagctgaagagaagcttccccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacgggg

SEQ ID NO: 2283 - DNA, 7704 bp, Homo sapiens
tctttctgatagcaggcagccatcttgcctggagcctgagaaagggaggagagacagaaggaaccggcgacagtggtctcagggccgctccggggggcctcaagaaccggaggcagccccggaggtggtccccgatcccgggctatgctcttggatctgagaagggaaggcggagggcggcggggacaagatgggtggagaatgtcaagcaaggaatgctaggcgggggaggggcgttgctatggcgactggggaggggcggtgtctgttctgaatcgctgtgtgtcacccgggcgctgcccaggaagggcagggctggggtgatgaccatggtaacacccgggggggagttcgtgacatctccggcgcggagggactcgatgtctatggcaatggtcgcctggtggaagggacggaactagatcccttcgctcgggacgctcacattccaggcccttgtcctgcaggctgccgcgggcggacacgccagaggaggaggccggggaatggccgcggtgtggcagcaagtcttagcagtggacgcgaggtgaggcgtggggtcaaagcccatgggagcagaacttactgtggtgcatgcgcaatggcgataagtgaggctgggcggagaacttgccttatgcggctgcgtgggcatgccggaggtgagcatgcgcagtagcgggggcgggcacgcccgcggtgagttggctgcgccggagaggattctaaacagcaagctgggaaaatgtggtcagatgtgggcatgcgcaaagcggctacctgtgagagggaggtggggctcaggcaggtgacatcctatcccctatgggtgtcccctagacttttttttttttacatcatcacttccccattctgaccccatcacctcccaacgctgacccccataatgtcagtctgatttctgtcgccctggtatactgaccctaattattgtctgcgctgacccagtcaccccgtagggaccccagcacggcagcagactgactctgttgtctgcaaactgacctcatgaccatgctcattattactgcagactcactcccaccacaggaccaagaggtccctcatcaccactgctagtcattcttaccacctaggccccagtcactgccacacacctcactctcctgccgtacccccccccccgagctgattgattccctctgtcctgtgcctgctgcctgccctgcatcctgaccctgcaggtacaacgcgtaccgcacaccaacgtttccacagtttcggacgcagtatatccgccggcgcagccagctgctgcgggagaatgccaaggctgggcaccccccagcgctgcgtcggcagtacctgaggcttcgggggcagctgctgggccagcgctacgggcccctctccgagccaggcagtgctcgtgcctatagcaacagcatcgtccgcagtagccgcactactcttgaccgcatggaggtgagcttctggccacattcacccccgggcataccctgcctgcacacattcactccactgactttcatcaagcacctgctctttgctgggcactgttctgcatcagcagaggacaaaaagataatatgccaagtaaaccagtaaacacacaaactttgtaaacaggtcagtaaacatatagcaagccctgtctttagtatctgctgagcagggggagggcaggaacagcagaactcgtgaggaagccactgcagtagtacaagtgggcagcggtggtggtggcaggggacacagtgagaagtgatctgactctaggtagattttcagggctccacacctcaaaggttctcgggctttttgcaagatgcacccaccctgaccctctccatttgcaggactttgaggatgatcctcgggccctgggggcccgtgggcaccgtcgttctgtcagcagaggctcctaccagctgcaggcgcagatgaaccgtgccgtctatgaggacaggtatgcaccagaggcagccaaggcggggggcgggttgcgaggaggagaggggccctggggcaatggcagactgaacactctcgcatctacctcctgtcacccctcacttcctattggggcccaggccccctggcagcgtggtgcccacgtcagcagcagaggcaagtcgggccatggccggggacacgtcactgagcgagaactatgcctttgcgggcatgtatcatgtttttgaccagcacgtggatgaggcaggtgagccagtgggtagcgggttccatcaccaagcgtttgcccaaactgtgacaaccaaccaaggcatccttttctgaatccaaggcccctggcacactccaaaggaggaatgaccatccataaagccttttgtagactgaaaatccctctgcaaagtggtcagtgcttcgtctactggaaagggcctcagaagcctaagagagagccctttgcagcaggctgcctgggttcctgagtcacttggaagagttcaaagcctttgctgatgataaatccccttgcagagggcagagtgggctacagtgtcaagggttttgcaaattgccaagaccttgattataaagtgttcgctaagacaggaactttttcatgttgcagaagacttttgcaatctgcaaaggagctgctaagacttagggagctttggcagagggtcttcaggggttacagttccctttgtcagccaaggaaagccctttgctgaggccactgttcctcatgcagtggggccccagccccaggcacacacgtcagagccttttagagagaaaagtgcccagtgagtgtgcagattcccactaatggcttcttggcattgcagtcccaagggtgcgcttcgccaatgatgaccgacaccgcctggcctgctgctcactcgacggcagcatctccctgtgccagctggtgcctgccccacccacagtgcttcgcgtgctacggggccacacccgtggtgtctccgacttcgcctggtccctctccaatgacatcctcgtgtccacctcactggatgccaccatgcgcatctgggcctctgaggatggtcgctgcatccgagagatccctgaccccgatagcgctgaactgctctgctgcaccttccagcctgtcaacaacaacctcactgtggtcaggctccaggacacccactcaccaagggctggtgggctgggtcaggaaggctatctgagggaatcagagtataaggagggacagccagggggggcctaggacccccccaccccccacccaatctcgtcagagcagtcctagtgtggtcagacttaaaagggaagcagatcagaagacgggagtgggccaggcgcagtggctcacgcctgtaatcccagcactttgggaggcggaggcgggcggatcacgaggtcaggagattgagaccatcctggctaacacggtgaaaccccatctctactaaaaatacaaaaaattagccgggcatggtggcgggcgcctatagtctcagctacttgggaggctgaggcaggagaatggtgtgaacctgggaggtggagcttgcagtgagccgagatggcaccactgggcgacagagcgagactccgcccccaccccccataaaaaggggaatgccgttcttgatctgggttggccttgctgtggtacactccagggagcacgggccagggtcagggttctggctctggagcccctttggtcccatcagctacagtcctacagttttccaactgcaggggctacctctgaggagcaggatgatgaggctgagcctcgtctggtctgtcagtggccccaccgtgtcagactccagggtagattggtcagagagcaggggaaggacattagaaagtctggtgtggcccggggtgtagtggggtgaactgcagaggaacagaccaagagtgagcttgtgggccgggatcctccccgcattagcagcagccccacaagttccagaaaggagcagccagggagcaggggaaagctgggatcacaggcctaggcaggccctatggttctcacactgtaggaggactggccaaggggcagcatgatggctctgaaggccctttagtcccgtaggcaggtggcctactctgggcagattgcaaaaggggctggctagggaggtggattcatgcctggtcaccttgtctacctgccacagccctattgtgaatagactctaatagggaccagccagtcgcatcaacagcagccccactgtggtcagactcaaggagggcctggctggaagcaggatgatggtctgtgcattctccccacaggtggggaacgccaagcacaacgtgcatgtcatgaacatctccacaggcaagaaagtgaaggggggctccagcaagctgacaggccgtgtccttgctctgtcctttgatgcccctggccggctgctctgggcgggtgatgaccatggcagtgtcttctctttcctctttgatatggccacaggtaggcagacagcaggcctgcatctgggtgctcgccctccagccctcccagggcacagccctcaccctcacctttgccttccctccctctgctgctgcagggaagctgaccaaagccaagcgtttggtggtgcatgaggggagccctgtgaccagcatctcagcccggtcctgggtcagccgcgaggcccgggatccctcactgctcatcaatgcttgcctcaacaagttgctgctctacaggtgggtcccccatcagggcctcctggagacggaggacctgcctcctccagcacactgggacagtagctcatctcctccatcaggttaatttaattgagggagcagtagtagcagtaacagtaatagcagtagtgagcgcgtttacagccatcactgtggccaggccctgttcgaagcagtttccacgtatcaccacattcaatccttgcaccgacctgtgaggtaggtgctgttattatctccattttgcaggtgagcaaactgaagcataaaatagattagggctacttaaagcagagacctgttttcctttcttccttccttcctttttttttttttttttttgcggggagtagtgtgggggttactgtccccactcacatctgtcatgttacccaaatgcagttctcagcctgggccacacattggaatgacctgaagagcttcaaaaactcctgtctgggcccctctacaggccagtaatttcagaagctttgggatgggcctgggcattggtagattgagaaattccctaagcaatgtctggccagtcctgaaaaccactgcctaacaggatgctttttattctacccctttatttctctcctcctttttaaacaatttctgtatatatacttaacaattttttaatttaagcgtacccttaagtttgcccatttcccacagcctctcctttcttcctcctgccacctctggcctcctcctgccacagtaaagcccattaatgatccacatctttccacatatccttctctttccacaaatcctaggcgtgtacatatatccatgtatgtttttgtttgtttgtgagacagggttttgctgttacccagattggagtgcagtggcatgatcatggctcactgcaacctccaactcctgggctcatgcgattctcccacctcagcctaagtagctgagattacaggcacacgccaccatgctcggccaacctttttaatctattttttgtagagatgaggttttgctgtgttactcagtctggtcttaaactcttggcctcaagtgatccttgtaccttggcctcccaaagtgctgggattacagacgtgagccaccttgcctagctcccaccacagttttgaaagaaagacgttttaaagaaatggccttttccggccaggcacagtggcgcactcctgtaatctcagcactttgggaggccaaggcgggtggatcacctgaggtcaggagttcaagaccagcctggccaacatggtgaatccccgtctctactaaaaatacaaaaattagctgggcatggtggcaggcgcctataatcccagctacttgggaggctgaggctggagaattgcttgaacttgggaggcggaggttgcagcgaggcgagatcgtgccattgcactccagcctgggtgacagagccagactccatctcttaaaaaaagaaagaaaaaagaaatggcctttcctacatttcgagtttctcaccaggcaatgccttgtggaaacccccccaggttacctgtggggacagtgttttattctctctaagggctgtgcagttttccacagtgtgggcataccatggtgtgttcatttcctctctttgtgcttatcttaataccaggatcttttagagacccttacaaagaaaaactagtgaatgaaactgcagaggctcccatttatatcaacagagacagtttctgaaccatcagtaactcacacatcagcccctacttatagtttatgtagtcatctcagaattgggtttcataagctgggtgtggtgtgtgcctataggtagtcccggctactcgggagactgaggcgggaggatcacttgagcctaggaggttgaggctgcagtgagccgtgatcgcaccactacactccagcctgggtgacagagtgagatcctgtctcaaaaacaaaaaaaaaaatatgggtttcatgaaccctgtaaagaacttaggcacaggggtggggacacaggcccacaacttgtctccctgctagggctggggctgtgttttgacccactctctcatcctctcagggtggtagacaacgaggggaccctgcagctgaagagaagcttccccatcgagcagagctcacatcctgtgcgcagcatcttctgtcccctcatgtccttccgccagggggcctgcgtgggtgagtcctgtagggacaggggatctgggtggctggggaggggcaggaaccagggctggtgccaacctggctcagacatcacgacaccgatgccctgacttcctggacctcatgacccctcctgccccaacagcctcactgtggaactcacagctccaaacagctcagagaactcacagtttgcacttgatctcggccaaaaggccgagaagtgatgaaaactcacactttgaacgcactaactccccaaacagcccagagacctcgcattctgcacacagtaccaaaacagccaggtgacctcccatctagggatggggccccctcaaacctccccaagccatgctaggacctcacacctcggacatacacccttcaacacctcagacacctcagggacttcccaccaggggcaccccaggcgcctcccgatggcctctccctctcaccccgacagtgacgggcagtgaggacatgtgcgtgcacttctttgatgtggagcgggcggccaaggctgctgtcaacaagctgcagggccacagtgcacctgtgcttgatgtcagcttcaactgcgacgagagcctactggcctccagtgacgccagcggcatggtcatcgtctggaggcgggagcagaagtagggtcctgtcggccctgctgctgtcctccatcccacccctcttactccagcctcgtgttgtaaataaagtttcggtggtcatgctgagggccggctcccagctctgccggggacggacagggcagagggcagcgggcagctccaggaacacggtggaacgggg

SEQ ID NO: 2284 - DNA, 6942 bp, Homo sapiens
accattggctcgctccgtaaggcaagagaacccactaggggatgagcccgaactagggatgtgacagagcgcgagacccagcctaaagagagcccggagccagcgtgggaggccgctgccgtcgcgcgccttggtgagtgccctccacccggcccctgctccctcccccagctctccccggctacgcggccagccctcggcgtgccagcgcgagaccctttgccacccgccccccccaccgcccttttgcgcctgcgcgagacccccagctaccgcacggttgtccagaggacagaagatccgtcttctcattgggcagcgggactggagggttctggttcggattgaccggctttgtgttccgttctagcgctgcacgccagacaccggcctttcaatatccgtctcttccctgcaggttgacggcgttgcacgctctcgcggggaggctctggctttccaaacgctggcaccgagggttgtagttctgattcgttttctttcctctgtcccccagttgcagttttcaggactacgtgggggagggaatagctttttgttgaacggtttaagacgctgacctgtgcaactggaccacgcctggttcctgtgtctcttaccaaaccgtgaccccggagcacaggactgggtttggtggtcgtgagcagtttgtgacccttgaaggaagacaccaggcctggtcctgtatctccctcgccagactgtgaccagggagggctgggatcaggtgttgttcccatgtgcctcccaccagactttgacccccgagggctgagaccgggactgtttctaccacatcataatatggcttctaaagggctggaacaagctttcagcctttctgtggccttgtgtttcagtcatgttctttttcttttcttttttattttattttgagacagagtctcgctctgttgcccaggctggagtgcagtggcatgaccccggctcactgcagcctctgcctcccaggttcaagcgattctcctgcctcagcctcctgagtagctgtaactacaggcgcacgccaccacacctggctaatttttgtatttttagtagagacggggttttgccatgttggccgggctggtcttgaactcctgagctcaagtggtccactcgtcttggcctcccaaagtgctgggattacaggcgtgagccaccgcgcccggccttcttttttagaggcagagtctcagactggagggcagtgatgtggtcactgctcacttcagccttgaagtcctgggctcaaagcgatcctcctgcctcagcctacctactagctgggactacaggcctttgtcaccacacctgactgattttcttatttttttagagacagtttcgctgtgttgcccaggccggacttgaattcctggcctcaggtgctgctcctgcatcagcctcccaaagcactggaattacctgccacggtgcctggcctttagtcatggtcttaaaacagaatgtaggccgggcgcagtggctcacgcctgtaatcccagcactttgggaggctgaggcgggcggatcgtgaggtcaggagatcaagaccatcctggctaacacggtgaaaccccgtctctactaaaaatacaaaaaattagctgggcgtggtggcaggcacctgtagtcccagctactcgggaggctgaggcaggagaatcgtttgaacccggaaggcagaggttgcagtgagccgaggtcgcaccactccactccagcctgggtgacagagcaagactccgtctgaaaaaaaaaaaaaaaaacggaatgtaattagaagtgttacaatcctgtctgttaactggtaaattcggtccatttacatttctcatgataataaactatttgaatttgattttattatctcattctgtactttctatttgtccaggtttttctgttccttttttttttttttttttaacttcctgcctatacacacgcagccatcagcccacaaagacatgactaccaacgcgggccccttgcacccatactggcctcagcacctaagactggacaactttgtacctaatgaccgccccacctggcatatactggctggcctcttctctgtcacaggggtcttagtcgtgaccacatggctgttgtcaggtcgtgctgcggttgtcccattggggacttggcggcgactgtccctgtgctggtttgcagtgtgtgggttcattcacctggtgatcgagggctggttcgttctctactacgaagacctgcttggagaccaagccttcttatctcaactctgtgagtcctgatttctttcatatgctgtgggatgggatttgctgggcagggatcggcttgcatgtttacctatccacctattcttcttccattgatttattttaaatttttatttaatcttttaaaaaatttattataggccgggcacagtggctcacgcttgtaatcccagcactttgggaggccgaggcaggtggatcacttgaggtcaggaatttgagaccagcctggtcaacatggcaaaaccccatctctactaaaaatacaaaaattagccaggcgcggtggctcaagcctgtaatcccagcactttgggaggccgaggcaggcagatcacgaggtcgggagttgaagaccagccaggccaagatgatgaaaccccatctctactaaaaatacaaaaattagccgggtgtggtggcacacgcctgtaatcccagctactagggaggctgaggcaggagaattgcttgaacctgggaggcggaggttgcagtgagccaagaccatgccattgcactccagcctgggcaacagagtgagactttgtctcaaaaaaaaaattattatgtattgttattattattctttttgttttttgcccttctctaaaactggtagataacttatttttgagacaaggtcttgctctgttgcccaggctggagtgcagtggtatgatgattgctcactgcaacctccaactcctgggttcaagcgatcgtcttgcctcagcctccccagtagctgggactatactataggtgcacacctttatgcctggctaatattttcacttttttgtagagacaaggtcttgctatgttgctcaggctgttctttaactcctgggctcaagcaatccttccacctcagcctcccaaaattctgggatgacaggtgcgcaccaccgtgcccagccttatttaacttttttgttgcatgtatattcacgtgggtcaaaaaaccatttaaagagatttgcagtgaaaatctgctttctatccactaagtttccccaaacgctgttaggcactgttgatagttgtttatgtttcttttcagtttatttacacacgtaagtctcaatttgctcaattgtaaaaggaggataatagtaataaccaactatatgtaagatacttagaacagtgtttggcaaacagtggttgccatgtaactgttcactattattatcattatttgcacttttccctttttacacaaatggtaatatgctatatatacttctaatcttttctctttttctttctttccttacaagaaaaccaaagaagccattttcttttttgagacggggtctcgctctgtcacccaggctagagtgcagtggcatgattatagctcactgcaaccttgaactcctgggcaatcaagcaatcctcctgcctcagcctccctagtagctgggattataggcatgtgccaccccaccaagttattttttttttaacaacttttttttttaagagatggcgtcttgctttgttgcccaggctgttctccaactcctggcttcaagtgatctgcccacctcagcctcccaaagtgctaggattacaagcatgagccaccgcacccagctgctttttttaatgaggtcactcctcatgatttcataaagagctttcaaagcatggacattgtacagttgcttgacttgtgtagtattgatgggcattttccctcaatcttctgccattataaacaaggccgggcagagtggctcatgcctgtaatcccagcactttgtgaggcgaaggcgggcagatcacctgaggtcaggagtttgagaccagtctggccaacatagtgaaaccccgtctctactaaaagtctaaaaattagctgggcgtggtggcaggtgcctgtaatcccagctactcaggaggctgaggcaggagaatctctgggacctgggaggcggaggttgtggtgagctgagattgcgccactgcacactccagcctgagcgataagagcaaggctccgtctcaaaaaaaaaaaaaaaaaaaaaaaacattacaggcatgagccattgtgcccggctggtcagatgtttcttaaattttagtcattccagtagatgtgagtgatatctcattatggttttaatttgcttttccttagtgactaatggaagtttgaacatctttcatatacttattggccatttagaaatcctctttgtgaagaacctattcaagtcttctgcctattttatattggatgatctttttctttctttcttttttttttttttttttgagacagggtcttaccctgttgtccaggctgagcactgtggtgctatcatagctcactgcagcctcaacctcctgggctcaagacatcctcccactgcagcctgggactgtaggcacgtgccaccacgtccagctaatttttgtatgttttatagagttgggggtctcactatattgttcagactggtcttgaactcctttatgcaagccatcatcccacctcagcctcccaaagtgttgggattacaggcatgagccatcgtgcccggcggtctttttctttctgattctctgctcactcttgtattcactcatctgttcacctacattctctctctctcattggctacttcactcactccatcatctacacctgcttccttttataccacacacacttcttgagtaccaatcacagccacactgttttgtgtcaggctttacacatattaccttgttttagagaaataaaccactagaatccaaacagttaccccatttcacggatgaggaagcagacgcatgggaaggttatgaagtctgtcttcttgcagggacccccagctctcacaagtgtgtgttcctttcactgcctttattcttcatatctctctcttcttttcttcagggaaagagtatgccaagggagacagccgatacatcctgtaagtgtttgcctctgtcaatggagactggcattggttttcggggggtggtgagttggggagcactaatgggctaacctgtaggaagagcacaccgataccagtgtcccctcatgctttctcctgcaggggtgacaacttcacagtgtgcatggaaaccatcacagcttgcctgtggggaccactcagcctgtgggtggtgatcgcctttctccgccagcatcccctccgcttcattctacagcttgtggtctctgtgggtaaggaaagggcactagaggggcactgggcactagaggggttgatgggggatccacagacacagatgtatccctgtgggtgggatctctcaacggtgcccttccaggggtaagtcagactgaatgacaaaccccctgaggctctggaaaggtcatgcccttctctgagcctgcactctcaggtggggagggttcatttttcttcctcctcctccttctccatcacaaagtctcctgtgaaggttacatgaggtggcccagggtggcaagaagcccctggaacctccaggatcagggctctgagatcccttcatgtaagattctgtcatattttttttaaaacagggtctggctctgtcacccaggccagagtgctatggtgtgatctcggctcactgcaacctccacctcccagactcaagcgatcttcctgcctcagtctcctgagtagctgggactacaggcatgtgccaccgtgcctggctaacttttgtatttttagtagagatggggtttcgccatgttgcccaggctggtctcaagctcctgagctcaaacagtcctcctggcttggcctcccgaagtactgggattacaggtgtgagccactgtgcccggcctcagtcatcttgtgttattaaattgttagctttctttagttctagcgatatgagttatctttagtcccagaatcctaagctgtcttggatttgaggattttgaacttccttaaatctgaaggtgtgagctctcctgagttctgaaattctcagctctctggtgtctggaatctcacttttctgatttctcagattttcagctctgtgatttcagaatacttagctctgagaccttgaatgatgacttggaaagtgctttggaatagagaattggcgaaagtgtccccttcctcactggggcttctccttcccctcctgccacccacaggccagatctatggggatgtgctctacttcctgacagagcaccgcgacggattccagcacggagagctgggccaccctctctacttctggttttactttgtcttcatgaatgccctgtggctggtgctgcctggagtccttgtgcttgatgctgtgaagcacctcactcatgcccagagcacgctggatgccaaggccacaaaagccaagagcaagaagaactgaggagtggtggaccaggctcgaacactggccgaggaggagctctctgcctgccagaagagtctagtcctgctcccacagtttggagggacaaagctaattgatctgtcacactcaggctcatgggcaggcacaagaaggggaataaaggggctgtgtgaaggcactgctgggagccattagaacacagatacaagagaagccaggaggtctatgatggtgacgatttttaaaatcaggaaataaaagatcttgactctaa

SEQ ID NO: 2285 - DNA, 22924 bp, Homo sapiens
cctctgcgcctgcgccccggcacgaggtggggcggcgggcgtcagtacagtagagtgtgcgccggggtggggggcaacggtcagccgtcaccctgagacgggcggcggcgggatggcaacagcctccggggcctcggacttgtctggctccggagcgcccccgcccggtgtgggagctcaggcggcggcggccgctgaggaggaggagcgagaggtggtgcgggtccgagtcaaggtgaggctggcggtgagtcggcccagccgccgaggcatcccaggggagggggaggcggtggctgtcataggatggagggcgggacctgagatttcggacataacctgagcggcgaagcttgagggccaagtgatgatggcgaggggtagggagggcctgagagcctgagagcgttagcgacgtaccttggggcgtgggactgaaaatagagggacgaggcgggggtctatgggatgaatgggtggagcttatagacaaaggggaggggctatggggctggaggaggggccgcagtagttgagggtggggctctgaggaatgagaaggtgctggctctggagtcagtcaacccatgtgttgagagtgcacttatgtgcaagttcccactttgatgagctgacaggctcgtgggtggagacaactaaagaaatgagatgcttcggacactaaaataatgaaaaaggttatgaaatagggagtcacgttagccaaggttgtacagggaaatccccagaggaggtattgaaggagcagagacccgaataaaaggagtcagccatgtgcatattagaagggaagagtattctaggcagaaggaatagcaagggcaaagactagaggatgggaatgagcctggcatgttcccgtaggttcctgattgctggagtggagagaatgaggggaagagtggtaggaggtgaatcagagcgctaagacagagacagatcgccaagggcctttggtgtgtatgctgaggaagaacgctgttgccatagttccagtaaacaatgatggtggctccgaccaaccagtggcactggcagtgataagagggtccacacatcacttcagtgtaatagagctctaaggtagaagtttgacattcagaaaaaagatgatgcctgagctgggcgtgaaccacgtgaagaaagtgggagggatgttccagacaggggatcagcacaatcaatggcctggagtcaggatggtttcaaggtaacttctaacagtttggtactactagagtgtaaagttcaaaaaacctggtgagaggctggctggggccccataggcccgcttgctgggactctagggttgccattgaagagattgaagcaggggagtgttgtaggtagatgtgttagattggttacagcaccatagaggactgatttaacaggagccagactggacacggtgattctggcaaccatagttgaagggatatagaagaaggattgggggcctgaactcttgcagtagcctcctcctcactggaccctgtggtccagaacacctgccttgatctggcccctggcacctctctgactttgccttctaccactctgcacctcactcttcagcatggtgatggggcccctggtggcctaccccatgtcttctctccccagaaatgtgagagcttcttgccgccagagttccgctcttttgctgtagatccccagatcacctcgctcgacgtgttgcagcacatcctcatccgagcctttgatttgagtgggtgagtgggaagatgctggggactggccagtgggccaccgacctctacagtggctatctggcctttgtttggtagggtttttgtttattttactactacaaataatcccacagtgaacagccacgtatgcatgtcttggagcacagtagtctacttttgtctgtggttttgctttctgcagtttcagttacccatggtcaacctcagtctgcaaatattacatacaataagatattttgagagagagagagagaccacattcatattacttttattacagtttacagacagtccccaacttacaataactggacttaggatttttcaactttacaatggtgcaaaagcgatacgcatttggtagaaactgtactgcaagtgcccagcgattctgcttttcactttcagtacagtgttcaataaattacatgaaatattcaacactgttgtaaaacagactctgtgttagatgattttcccaactgtaggctaatgtgagcgttctgagcacgtttaaggtaggctaggctaacctgtgatgtttggtaggataaatgtgttaaatgcattttcctttttatttctttttttttttttttttgagatggagtctaactgtcacccaggctgcagtgcagtgacatctcccaggttcaagtgattctcctgtcacagcctcccaagtagctgggactacaggcatgcaccactatgcccggataattttttttttttttttttttgagacggagttttgctcttgtcccccgggctgcagtgcagtggcgcagtctcagctcactgcaacctccgcttcccgggttcaagtgattctcctgcctcagcctcccaagtagctgggattacaggcacgcaccaccacgcctgctaatttttgtatttttattagagacaaggtttcaccatgttggtcaggctagtctcgaacacctgacctcaagttacctgtccacctcggcctcccaaagtgctaggattacaggtgtaagcccccgcacccagtcccagatagttttttgatcttctcttttttttttttttggagacagagtctcactctgtcacttaggttggagtgcagtggtccgatgttggctcattgcagcctttgcctcccgggttcaagtgattctcatgcctcagcctccagagtagctgggattacaggtgtgcaccaccacactcagctaattttcatgaggttggtcaggctggtctcaaactcctgatctcaagtgatccgcccacctcggcctcccaaagtgttaggattacaggcacgtgagcctccgcacccggccaattttttgtatctttagtagagacagggtttcgccatgttgcccagggcagtctcaaactcctgagctcaagcaatccgcccgcctcagcctctcaaagtgctgggattacaggtgagccactgcgcccagccaaatgcattgtcaacttacagtatttccaacttacgatgagtttattggtacataaccctgtcataagtcaagaagcatctgtattgtcataattgttctattattgttaatctcttactgtgcctaatttatcaattaaaccttatcataggtatgtatgtatatgaaaaaaaacatagtatatatagggcttggtactatctgcagtttcaggcatccactcgggggggtcttggaatgtatcccctgtagataaagagggactactgtatttggaaacatctagtcataggataaattcctagcagtggtattgccaggtaaaagggtatttgctttaaaaaaaattttttttttgagacagtctcattctgtcgtccaggctggagtgcagtggtgtgatctcgtctcattgcaacctccacctcctgagttcaagcaattctcctgcctcggcctcctgagtagctggtactacaggcgtgcgccaccatgcccggctaatttttgtatttttagtagagatggggtttcaccgtgttggccaggatcgtctcgatctcctgacctcgtgatccacccgcctcagcctcccaaagtgctgggattacaggcatgagccaccgcacctggcctgctttttgaactattaatgggtgtttccaaaatgctctccagacaggttttatcaatttatgatctcagccgggcgctgtggctcatgcctgtaatcccagcactttgggaggctgaggcaggtggatcacgaggtcaggagatcaagaccatcctggctaacacggtgaaactccgtctctactaaaaatacaaaaaattctccaggcgtggtggtgggcgcctgtagtcccagctacttgggaggctgaggcaggagaatggcatgggcccgggaggcggagcttgcagcgagccgagatcgcaccattgcactccagactgggcgacagagtgagactccgtctcaaaaaaaaaaaaaaacgaatttatgatctcatcagcagcacataaatgcctgtttccctcacaccctcgcaaacattggttactgtaaaactgcaaaatttgccaatctgatagctgaaaagtggtgtctcttgggggcagatgtgatagtcattttgttgtgattttggaggaatacatacacatggtaagaaattcaaacagtacacaattgttgggtatttaggatgtttccatggttatgatgagcatcacgcaacaaacttctttacatagttgcacaagtatagctgaaaaattcttagttgttattagactttcttacataaacatttttgttgtgaaaaataacaaacacagattgctttttttttatgtagtaagaaggctgctttcttcccacttctgtcccacatctaccccagaggggaccaacttttttttttttttttgagatggagtcttgctctgtcacccaggttggagtgcaatgccacaatcttggctcactgcaacctccacctcccaggttcaagcgattctcctgcctcagcctcctgagtagctgggattacaggcacctgccaccacacccagctaattttttttgtatttttagtacagaaggggtttcaccatgttgaccaggctagtctcaaactcctgacctcaggtgatccacccacctcggcctcccaaagtgcggagattataggcgtgagccactgcacccggccaacattttaccagtttccaatgtgacctccagatacaagcaggtgtgtacctgcttgtatgtgtttgtgtaacaaagtgggtataaatgacctgatctcaggctgcccataatccttggcacagtaccttgcacatagtaggaagttgttttcaacgccttctatattaccctccttgttttggaaactgtccctgaggcctccagggcaccaggggccctgagagctccctcgtatcccctgtccaggaagaagaactttggcatcagctacctgggccgggaccggctaggacaggaagtttacctctcacttctatctgactgggacctcagcacagcctttgccactgcctccaaaccttacctgcaattgcgtgtagatattcggccctcggaggacagtgagtactcagtgcccccaggagcactgctctggaacccctttaccccatagggtgatgctacccctcacagtacactccctcatggtgggatgggtagcaaggtatcctagctatagatcctggctcagccactaggccacaatttcttcacttgtaaagagataattgtatcttagaaccattgtgaggccttgtatcttagaaccattgtgaggggaaattcatataaaatgcctggaacagtgcatgactgcataatgaaggctcagaaagtgttatctctaataatgataattatattgtattatactattataacatataaccgagtaatgtatgtaataattagatataatgcagatttataatatagtataacggtatagctttagcattatgtatttcagttataatacctaaatataacaatgcgtattataataatgctagttgtgtttattcattcagtcattctgcacccatattcatttgtttgtattcttgctcactcattcatttgttcccttgacctctcagccactttttctcttctcatctttgttcttccactcttgcctattctggtccctgcgagcacacagataaattaggacgtggtctcaaaatttgattacagaccatacattagataattgtatcagtattaaatttcctgggtgtgtgtcttagtcgttttgtgctactataacagaataccacagactgaggaatttgtaaagaagagaaatttatttctcacagttttggagactgggaagtccaagatcaaggtgctggcaggttgtgtgtctagtgagggctttcttgctgcatcctcacatgacagaagagcagaagagagtgaacccacaccctcaacctctttataagagcccaaatccgctgggcacggtggctcatgcctgtagtcccagcactttgggaggctgaggcaggcggatcacctgaagtcaggagttcgagaccatcctggccaacatggtgaaaccctgtctctactaaaaaaaatacaaaaattagccgggtgtagtggcacatgcctataatcccagctactcgggaggctgaggcatgagaatcgcttgaacccgaaaagcagaggttgcagtgagccaagatcttgccactgcactccagcctgggtgacagagcgagacttcatctcaaaaaaaaaaaaaaaaagaggctgagcacggtggctcacgcctgtaatcccagcagtttaggaggccgaggcgggcagatcacaaggtcaggagatcgagaccaccctggctaacacggtgaaaccctgtctttactaaaaatacaaaaaaatagccgggcgtggtggcgggtgcctgtagtcccagctactcgggaggctgaggcaggagaatggcatgaacccgggaggcggagcttgcagtgagccaagatcgcaccactgcactccagcctgggcaacagagcaagactccatctcaaaaaataaataaaataaaaaataaaaaaagagccctaatcccatctgtgagagctctaccctcaggacttaatcacctcttaaaggcccccacctcttaatatgatcacattggtaattaaattgcaacacatgaatttggaaggacacattcaaaccatagcagtgtggtagtggtatcatatctattgaaggaaaatatccttgttcttgggaaagacacagttaagtatgaaggggtaaaatgtcatgatgtctgcaaataagttggcaaaaataatgtgtttatatacagagagagtgagataaagcaaatgtggcccaaaaaaatgttaatagaggatctagatgaagtatgtatgggtgttcagtgtattcttttaactttattgtaggttcaaaattgttttaaatagttgtggagtggaagatgtggttcccagcctcaggaaactcatgtgcccatttgggatgagtcgagcactttattgatgtcataataacatataactagctaatgtgtagtgaacacttagggccattctgtgcacataatattttttcactgaattgtcaaaataatcctatagagtagggacaatcattttccccatattatagatgaggaaactgaggctcagagaggtgacaggactcgtcccagttatacagacagtaagttgaagagcaagatttgaactcaggcagtggctgaactggctccagagtccttgttcttaaccatttaactctacaacattttggacttgttaaaattggcagctttgcaaaagagagacagaggagagagagaaacaagagtcagagggaaagatagtgacagagatgggcaggaagccaaataggaaaagccaggtagccagacacacaggaacctctgccactgagtagccatatgtgcttatgtcagtcacttaattccctgggccttgttttcctcacctgttaaagagacacagtagcactatttcaggaaaaaaatcaaatctgcatggctacgaaacatgtggagaaaaccccaagtgcatgagaactgggacgaatgccagtaaagcagagagacagacagaaagacacccagtagtctggcaggaatacatctttaaaaggttatctttttaggccaggcgccgtggctcacgcctgtaatcccagcactttgggaggccgaggcgggtggatcacctgaggtcaggagttcgagaccagcctggccaaacatggcgaaaccctgtctctactaaaaatacagaaattagccgggcgtggtggtaggcgcctgtaatcccagctactcgggagactgaggcaggagaattgcttgagcctgggaggcggaggttgcaatgatccgagctcgtgccaccgcactccagcctgagtgacagaactagactccatctcaaaaaaaaaaaaaaaaaagccctctgtcttatttaccaaattcctgcacaacatcggtctgtttctgaattcctgattctcttacgttgatctatttattaaattataagccaattctatgttgttttaatcattgtagtagtttgttttctgtttgtttgtttggttttgagggttttttttttgttttttttttgagacagggtctcactctgtcatccttgctggagtgcagtggcccaatctcagctcactgcagcctccacctcccaggctcaagcaattgtcccacgtcagcctcctgagtagctgggcctataggcacatgcccccatgcccagctaatttttgtattttttgtagagacagggtttcgccgtgttgcccaggctggtcttgaactcctggactcaagcagtctgcccgcctcagcctcccaaagtgctgggattacaagcaagagccaccgcacccagccttaatcattatagttttatgatatgttttcatgttttcctttttaaaaaattttcttgaatattcttgttcacttactgttctttttatttaataaatcagcttattattccattaaaatcctgacgggaatttgattggagtcatatttttaagagaaactaatctttcattacccagtaaatacattcttattaaaaataaaagcattttaaataatgctgaagtctcctgggaacgctatgcctaatctcaatcccctaccctaccctttttgccccgagggaatcggtttgatgtgtaactttgcatgtcctttacttatttacactccctacacacacatttatccacatatgtgagtatattcatatttgcgtgtctgtacacataaacggtatgtgtttaacataaggtattctacacattaatatgtaagtgtccaatatatggagctatcattagacatattaatggcattctcatgatcattttcatggctgtgaaagcaacagacatgttgggactgtttggatggcccagtccctctttctgggaaaaagccagtttctgtcacctctacagttgggagattacaaagcctagacctttgaccaatttgtacttttccgatatgaatcttttttctttttgagactctctttgtcaccaaggctggaatgcagtgacgcaaatatggcccactgcagccttgacctcaagctctcctcctgcctcaggctttcaagtagctgggactacaggtgtgcaccaccatgcccagctaatttttgtattttttgtagagacatggttttgccatgttggccaggctggtctcgaacttctgacctcaagtgatccacccacctcggcctctcaaagtgtttggattacaggcgggagccaccgtgcccagcccccaacctcctttctatcataggtactgcaaatatttttcccagttgatcttttgttttttggctttgcttacgggatggatctgttttgtcctatcaaaattaaacatttgattgcacgcctacacagatatctatctttttctttatgatttctgagtttctcctttttattgcaggtggagggacagagtttcactctcattgcccaggctggagtgcgatggcgcgatctcggctcactgcaacctccgcctcctgggttcaagtgattctcctgcctcagcctcccaagtagctgggattacaggcatgtgccactacacctggctacttttgtatttttagtagagatggagtttcaccatgttggtcaggctggtatcgaattcctgatctcaagtgatccacctgcctgggcctcccaaagtggtgggattacaggcatgagccactgtgcctggctgagtttctcctattactttggaacatgttccccatccataagcttatacaaatattctatattttcttctactatgcttattgttttcttttttacatataaatcttttctctgtcagcattgtgataagcagacctagctttaaaaaaatcaagatagtcaattatgccagcatcattttttttaatttaatttttttttttgagacgaagttttactcttatcgcccaggcaggagtgcagttgcacaatctcagctcactgcagccgccgtctcctgggttcaagcaattctcctgactcagcctcccaaatagctgggattacaggtgcccgccaccatgcctagctaatttttgtatttttagtagagatgaggttttgccatgttggccaggttggtgtcgaacttatgacctcaggtgatccacccacttcagcctcccaaagtgctgagattacaggcatgagccactgcgcccggcctgccagcatcatttattaaataatcaccttttctgcagtgattcgaaatgccacgtttgtcacatattcagtttccatatatacaagcttggatttatttctgggctttctattgcattctaccaatgggctctatttgtctactgctgtgctaacaccatgttatttttatgacagtggttttgtggtcaaatttttttttttttttgagatggagtctcgctctgtcgcccaggctggagtgcagtggcgcaatctcaactcactgcaagctccgcctcccgggttcacgccattctcctgcctcagcctccctagtagctgggactacaggcgataagcttttgccatcctcccactgttctttgtcttaactttttttttttttttggagatggagtcttgctctgtcgcccaggctggagtgcagtggcacaatcttggctcactgcaagctccacctcctgggttcacgccattctcctgcctcagtctcccaagtagctgggaccacaggcgctcgccaccacgcccggctaatgttttgtatttttagtagaggcagggtttcaccgtgttagctaggatgatctcgatctcctgacctcgtgatccacccacctcggcctcccaaagtgctgagattacaggcatgagccaccgcgcccagcctgtcttagctattcttaaatgtgaattcttctatagaaaccttaagataattttatccggttccaggaaaaacccccattcaatttctgactggcattgcactgagtttatatattaatttagggtttgggaagtttgacaattttatgataaggaaatgcgcgtatcatgaatattatgtaataccacaagcagggtctgggccagcagccaagcagcccacaatgaaacacttggatgtttcttcagggaaatgtgtgcatattcacactacgtgggttatataaagactatatatagtctcctgtcagttcagatcaggttttgctactaggtgagtttgtgtttgtagacattctttgcctgttttttgtttgtttgtttgtttgtttttttgagacactctgttgccaggctggagtgcagtggcacaattccggctcactgcaacctctgcctcccaggttcaagcgattctcctgcctcagcctcttgagtagctgagattacaggcacgcgccaccacgcccagctaatttttgtatttttagtagagacggggtttcaccatgttggccaggacggtctcgatctcttgaccttgtgatccgcccgccttgcttctcaaagtgctgggattacaggtgtgagccactgcgcccggccttttttttcctttttttgagagggagtctcacattgttgcccaggctggagtgcagtggcgcgatctcagctcactgtaacccctgcctcccaggttcaagcgattctccttacctcagcctcccaagcagctgggattacaggcacctgccaccacacctggctaatttttttttgtattttttagtagagatggggtttcaccatgttggccaggctggtctcaaccttgtgatccgcccacctcagcctcccaaagtgctgggattacagacgtgagccaccgcgcctggcctctgcctgttttattagtgggattgagggggtggtttttttaatcagtataaaatgtctctttgtgttaaatgcttttggccttgagtgatgctttttctgacattctcatggctactatttttttctgtttgtgtttaccagatatacctttaggattctttaatttttaacctttttgtgtcacctagttttaggtatgtctctcatacctctcgtaaaaacgtcatagcagaatttatgctttttaaggcaactgacagtgaaatcttttttttttctttttgacacgtagtctcgctctgtcgcccagactggagtgcagtggcacgatctcagctcgctgcaacctctgcatcctgggttcaagcaattctcctccctcagcctcccgagtagctgggattacaggcacacaccatcatgcccggctaatttttttttttttttttttgagatggagtttcgctctgtcgcccagactggagtgcagtggcacaatcttggctcgctgcaacctctgcatcctgggttcaagcaattctccctcagcctcccgagtagctgggattacaggcgctcaccatcacacctggctaattttttgtatttttagtagagacggggtttcaccgtgttagccaggatggtctcgatctcctgacctcatgatctgcctgcctcggcctcccaaagtgctgggattatagtcgtgagtcactgcaccccgccccaacagtgaaatctttaggccactttttctcctttaatctctcccactttttctggcctttaaaatggagctttggaacacttgtaattcttattcgttttctggtccctaacccttaacttctagcttttgcttagacaacttttttttttttttgagatggagtcttgctctgttgcccaggctggagtgctatggcacaatctcagcttaccgcaacctcctcttcccaggttcaagcaattctcctgcctcagcctcttgagtagctggggtaacagaagcgcaccaccacacccggctagtttttttatatttggtagagatggggtttcaccatgttggccaggctggtcttgaactcctgacctcaagtgatttgcctgcctcggcttcccaaagtgctgggattacaggcatgagccaccacacccagccaattttttttctttttaaattccgggttatcattctgttttcttactaacacactaagtcacttatgtttcaggaatcctaatgtaacatataatattacaaacccccaatcatgttatcgttgtcattttaactataaatattaaatatgtaatatatataatataatatataatatataaatattaccatttaccttcccctttgtctctccctatcttaagcccttctagtcatgcaggagtcatttgctcagagaacttctttgttctcctccaaaagtgcatgggttagatgtactctaatggccaaaaatgtttttatttggctgaatagatctgtactgtcttggctgggtgtggggcccttggatctcaggtctttcttcttagtgctccataggtgctgtgagctactgtcttattgcctccagggttgtgaagcagaagtctgttgcttgtctgaccttctttccattgtaagcagccgttttttgtctctggaagctgcaagagtttttctttttcttttttttttttttttttttttgaggcaggatctctatttcccaggcgggagtgcagtgacgtgatctcagctcactgcaacctctgcttcccaggttcaagcgatcctcccacccacctcagcctcccgagtggcagggactacaggtgtgcgccaccatgcccagctaatttttatatttttgggtagagacagggttttatcatgttcagcccaggctggttttgaactctcgggctcaagcaatccgcccgccttggcctcccaaagtgctgggattaggctgggcatggtggctcatgcctgtaatcccagcactttgggagaccgaggtaggcggatcacttgaactcaggagttcgagaccagcctggccaacatggtgaaaccccgtctctactaaaaatacaaaaatttgccaggtgttgtggcgcacacctgtagtcctagctacttgggaggctgagacaggagaatcgcttgaacccgggaggcggaggttgcagtgagccaagatcacgccactgcgctccagcctgggcaacagagcaagactctgcctcaaaaaaaaaaaattgctgggattacaggcatgagccattgcgcccagtctaagagtttttctttattcttagaatttgggcatttcgggctgggcgcagtggctcacgcctgtaatcccagcactttgggaagctgaggcaggcggatcacttgaactcaggagttcaagaccagcctggccaatgtggcaaaaccctgtctttactaaaaatacaaaaattagcaaaaattagccgggcgtggtggtatgcccctggaatcccagctacttgggaggctgaggcaggagaatggcttgaacccaggaggcggaggttgcagtgagccgagatcataccattgtgctccagtctgggtgacagagcaagactccatctcaaaaaaaaaaaaaaaaaaaggatagggttggtggggggcctgttgtgtgttgttagttaattaatcctatctaagacttggtgagccattccttcatctcagggaaattttctttcatacttgtttaattctgacatctccacctgatcccttttctccccctgcatttcctattatttccatatttggtctcctggacttggcatccaggtctctctactttttcactcaaatcattgaaccttagctccatgccttgcagtggttcttctgttcagactttcagaccattactgatttttcataatgtgaccttcttcattttacctgttaagtgttttaatgctctgattaatgttttagaaagaccattctggcagctgttgggagagattggagaggaatacagaggaagtgaggactggttaggaggcagtttcaggtgagagatatggtggctcagacagggtgagaagatggagatgagagaacaggtaggatggaggaatgctttacatgcagtagccgtaggacttggcggtggtttggacctgggagttaagagagtgggagggggacaaggatgtctctcaggtttctggtctattaaacaactgaacagatagagatgctgtttgttgagatgaggagtagaggaggaggccatgtctagagtggatcttgggctcctctctttggaccccttaggtttgcagtaccccatgagacatccagggaaaagcagtgacatgcaaacatggcctagggtttgttccccccctcagctctatgggaaaattgggctccatgggaatgctgtttagggatggcatttgcttgcaaatgacagtggcttaaacagatagaagttgattggtttcacacaaaagagtttgaaagttagccacttgggccggatgcagtggctcacgcctgtaatcccagcactttgggaggccaaggtgaagggggcctgcccctccacacttgtgggtatttctcgttaggtggagacgagagattgagaaaagaaataagacacagagacaaagtatagagaaagaacagtgggcccagggtaccggcacactcagcatgcgaggacctgcaccagcgccggtctctgagttccctcagtatttattgatcactatttttactatcttggcaaggggagtgtggcagggcaacagagtgttggtggggagaaggtcagtagggaaacatgtgagcaaaggaatctgtatcatgaataagttcaaggaaaggtactgtgcctggatgtgcatgtaggctagatttatgtttcactttacacaaatatctcagtgtagcaaagagtaacagagcagtattgctgccagcatatctcgcctccagccacggggcaattttctcctatctcagaatagaacgaatggtcggctttacaccgagacattccattcccagggacaagcaggagacagaagccttcctcttatctcaactgcaaagaggactccctctttcactactcctcctcagcatagaccctttatgcgtgtcgggctgggggatgtaaggtctttcctttcccacgaggccatatatcaggctgtctcagtgaggggaaactttggacaatacccaggctttcttgggcagagttccctgtggctttccacagtgcattttgtccctggttaatagagaatggagaatggcgatgacttttaccaagcatactgcctgcaaacatattgttaacaaggcacatcctgcatagccctaaatccattaaaccttgattcaatacagcacgtttctgtgagcacatggttggggctaaagttacatacagattaacagcatctcaaaccagaacaatttttcttagtacagatcaaaatggagtttcttacatcttccttttctgcatagacacagtaacaatctgatctctctttcttttccccacataaggcgggtggatcacctgaggtcaggagttggagaccagcctggcaaaccccatctctactaaaaatacaaaaaattagccaggcgtggtggcaggcacctgtaatcccagctactcgggaggctgtggcaggagaattggttgaacctgggaggcagaggttgcagtgagcgaggatcacaccattgcacgccagtgtgggtgacagaacaagactccgtctcaaaaaaaaaaaaaaaaaaaaaagccagccactggacattgccattgttggcttagtagccctctcgtatcagggctgtaggagaggatctctgaagatcctctcgaacctactctcagatggccactgctgcttcaaccaccacatcttatgtgaggtgggaagaaagaatgcggggcaaaatgaaaaagaaagagaaacggtcaggtgcagtggctcacacctgtaatcccaacactttgggaggccaaggcaggaggatctcttgagcccaggagttcaagaccataggcaatatagtaagatcccatctctaccaaaaaaaaaaaaaatcatccacgcatggtggcacacgcctgtaagccccagctactcaggaggttgaggcaagaggatcgtttgagcccaggagtttgaggctgcagtgagctatgatcgcaccactgcactccagccttgggggacagagcaagactgtctcaaaaaaagaaaaaaaagatgcctgtaatcctagcactttgggaggccaaggcgggctgatcacctgaggtcaggagttcgagaccggcctgggcaacatagcgaaacctcatctctactaaaaatacaaaaattaggccaggtgtggtggctcatgcctgtaatcccagtaccttgggaggccgaggcaggtggatcacctgaggtcgggagttcgagaccagcctgaccaacatggagacaccccgtctctactaaaaatataaaattcaccaggcatggtggtacatgcttgtactcccagctactcgggaggctgaggcaggagaatcacttgaacccaggaggtggatgttgcagtgagccgagatcccgtcattgtactccagcctgggcaacaagagtgaaactccgcctcaaaaaaaaaaaaaaaattagctggacctggtggcaggcacctgtaatcccagctacttgggaggcttaggcaggagaactgcttgaacccaaaaggtggagtttgtagtgagccaagattgcaccactgcactccagcctgggcgacagagtgagactccatctcaaaaaaaaaagaaaaaagaggctgggtgcagtggctcacgcctataatcccagcactttgggtaggccaaggcgagtggatcacgtgaggtcaggagttcaagaccagcctgaccaacatggtgaaactccgtctctactaaaaatacaaaaattagctgggcatggtggcaggcacctgtaatcccagctactcgggaggctgaggcaggagaatcacttgaaaccaggaggcagagtttgcagtgagctacgttcacaccactgcattccaccctcggttacagagtgagactccgtctccaaaaaaaaaaaaaaaaaagcatatacggcatacctgttccacttttgcacaaatattttatttctaaagtatgtctgggctctggactagggtgaatgaagttcagatcccagccctactatttcctggctgtagaatcttggtcacttactatttgttccaaacctttttgtcatcgtctgtaaaatgagaatggtaatattagcgtgcactgtttgtgggaggaggactggcaaaaatatgagagtaggagtttgggctcttgagcttgggcctggccttcaaatttccactctttcactcactagctaaggggccttgggcaagtaccttatcatgactgtgcctgtttcctcaaagagagtcatggtagtagtagtactcaaccgataggactgaagtgactattgcatgagtcagtattggcaaagaattcagaatagttcctggcatacagcactgtggaagcattagctagtattattatttcttatattgctgttgagcgcttgtcctagtgcttggcacatagtaactgctcaataaatattactttatatcattaaaatattagaggctgcccagccagttcctgagacatctactacaaaagaattgttcatggtttgattttgttttttacatgatttggatgatacaggaagagggactgggagttgtttgttcccctgcaggtagcccggcttcagtagaaggagaggaagccggccctgaggtctgggttatcatccccattcttatagcactttgttctgtttgcccaggcccattgctagaagactgggacataatcagccccaaagatgtcattggctccgacgtgttgctggctgagaaacggtcatcactgacgactgccgccctgccctttacacagtccatcctcactcaggtgttttcagggaccctagggacccagctgtggttggagggcagagccttcctggcaccctggttctgagcatgctggttggcatctgcccctagtccacacagctgatggtggcctccctccctcctcataggtgggccgtaccttgtctaaggtccaacaagtgctgagctggtcgtatggggaagatgtcaagcccttcaagccacccctgagcgatgctgagtttcacacgtacctgaaccacgagggccagctctcccgacccgaggagttgcgcctgcggatctatcatggcggtgtggagccctcgctgcgaaaggtgagcatcctcagtcatctgttgggtccatcactgctgcactcattaacagctcctgagacacatgcagtcagccacactgctgtgggcaagggtggagatgttacagggcacgaagttctctttaaggaggggcgagcagtcggaggcctagcagacttagaaggaagacagaggcccaaggggggtgggtgggtggcaactgatagacattggggtatggtttatctggagaactccagcctcatccctttcacccctgggcaggtggtgtggcggtacctgctgaacgtgtatccagatggactgacaggccgagagcggatggactacatgaaacgcaagagccgcgagtatgagcagctcaagagcgagtgggcccagcgagcgaaccctgaggacctggaattcatccgcagcacggtcctcaaggatgtactgcgcactgaccgggcccacccctactatgcggggcctgaggatggcccacatctacgggcgctgcacgacctgctcaccacctatgccgttacccacccacaggtgtcctactgccagggcatgagtgaccttgcctcacccatcctcgctgtcatggaccatgagggccatgcctttgtttgcttttgtggcatcatgaaacgcctggccgccaacttccaccctgacggccgcgccatggccaccaagtttgcacacttgaagctgttgctgcgacacgctgaccctgacttttatcaatacctgcaagaggcaggcgctgatgacctcttcttctgttaccgctggctgctgctggaactcaagcgtgagttcgccttcgacgatgccctccgcatgcttgaggtcacttggagttcgctgccccctgatcctcctgaacatgaggtagagctggttggaccccccagccaagtggcagacgctggttttggtggccacagggggtggcccgtgcgacagaggcacatgctgaggcctgctggtggaggaggtagtacctttgaagatgctgttgaccacctggccacagccagtcaggggcctggtggtggggggcgtctcctgagacaggccagcttggatggcctccagcaactcagggataacatgggctccaggagggaccctctggtccagctgccccacccagctgcccttatcagctccaagtccctctctgagcctttattgaactccccagacccactgctctcctccttttcccaccctgattccccatcttcctcatctccaccatccacccaggaggcctctcccactggtgatatggctgtaggatcccccttgatgcaagaggtaggctccccgaaagaccctggaaagtccctgccacctgtaccaccaatgggcctgcccccaccccaggagtttggccgggggaacccattcatgctgttcctctgcctggccatcctgctggagcaccgcgaccacatcatgcgcaatgggctggattataatgagctggccatgcactttgaccgccttgtgcgaaaacaccacctggggcgcgtcctgcgccgggctagggctctctttgctgattacctgcagtcagaggtgtgggactcagaggagggggctgaggccacagccgcatcttgatcaggctttctcaagccctccatcggccccaccagatctccattctttgccatgagggccaacacatgagaccccacctccctccctgcctgccagccctagacttgttggagcatagagcccttcctccccaggcctaagtatgtggagctctgctttggcactgccccgcagaggccacgcctatttattctgtttctgttgttttgtttttaacaactatactttgcacacatgaaggtcactgtggtttgtgtgtttctctgcctcctccctgggttttgctgtagatggagtcctcaggggccctttacctgatggaggggaaatacttcacttggtggagagaggctccagcttcccccttgtgatggggagagtggatgctgacaatcagttcccaaaggtgagcccaggtggagcactgcttgaggaaggcctgagtctgtttttttggtacatccatcggcctgtaagggtctgtattatggctgtgaatatatgttttcaggacagccccctggatgagagataagagagttcctggctcaaaaaaggacaagattctttactgagattgggaagtatgggctacttagaaacgttggagcagccacccctggcattccacatgtcaccatttctaggatcttggcctctctgtgaggtttatgcaccaatgctggcagccctgggcaggggcctcggcctcctttttgttttccacttcagacaggtaccgtgcagatgttaacaaggtttgagcgaggtgcatctcacacaagtgtgaaagcccaatcatcacattgttgaattacaaaaggatctagggctcctattcttgtcacttgctttggagccagtttgaaagactggcctagcccatgcctagcggccctaaactgggattccagctcacagcacctgtcttaaccatttcagcagtagaaaccacttatttaccttctccatctcactaatatggacaaacaacaagcactgataaaacgcaggccctaatagaattcacttcgttatttggaggataatgatcaaaaaaaggtcctttttcccactgacatgctcagagggtgggattctctcacaggccaggtgctgtcatccacaaaggatgggtgaaataactggggtcctcaggtcacggtctagccacaccagcttctcccaagtactaaccaggcttgaccctgcttagcttcagaggtcagacaagatctggcatgttcaggatggtatggctgtagaccaggctgggttctggccagagctgttgcactaggcaatgctgccagagatgaggaggcatcagggcagtcatcccttctgctgtttgccccaagaatgccatacaaacctggggatgacccttaaaagtctcccgtcacccccagtattggggggaagctgactattcctcagatgatagcccagtcacttgaagaacaggacaagactattctgtgtctagggggctcaagcactgtgtgtgggtctaacgaatgcattttgtggaaatgggctcagactccccaaagggccatccaacctatgggagtgtctggccttctgaggtcctgaaatgtctcttttgtcagtaaacagctaataccctc

SEQ ID NO: 2286 - DNA, 11833 bp, Homo sapiens
gcgccgctctgggagccgctgctggtcccggccttgcggcctgcgggggaggctgcccggaggaggcagcggcggcggcagcgcgtcctcggtccccaggaccacggcttctttcctgccaggtaggtcgccagtagtgcgcacgcggctccccagctcccatccctgggccggcctccccaggcggatctgtagcgcgagtgctaggaccccctccccatcacctttccgactctccctcaggctatgtctcctaccaccacctccttgcagcccccggacctgggcaggactttgttggcggcctctcgccgggtggggatgagatggggggcgcggaggatacaggacaccccccctccccgtgccgccgcatccatacaaggagagatgcacacggcccccaagtgtcacagaatccccctctctgccctccactcagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 2287 - DNA, 7704 bp, Homo sapiens; identical to SEQ ID NO: 2283

SEQ ID NO: 2288 - DNA, 11032 bp, Homo sapiens
gatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcggtaagtgcctgccataccgtgtgccaccatgccaggccatatcagacctcccacattcatccatatcgagccacaccttaccctgtcacatcctgccaggccctagcatgtccaagctggaccccaacatgttcagccccaccacatcccaccaggccaaaccccattccaccataccacatcctactatgccagccaccccatgccatgccacaccgagccacatcctgccatgccaagccatgcccttcagtattcctgagttctgggattccagaaagctgagattcttggatcttgggattctgaaatgtctacatcccaaggttataagacattggcatgctgatgtcacagggttatggaatcccaaagtaccatgattacagcgtttggagattctgacaatttgaaattctcacattctagacttctaaaatgttggcattgtggatttctataatcagggcatgatgcgatttctggattctaggattctgaaatgtttccacagtcatagcaggcctgtatcttaatgaaagattccaagtccccaagattcctataggaggcggagatttctggaaatctgagatccgaaggttctacactttcttttttctttctttcttttttaattttaaatggatgttctattttttcccaggtttattattttgaaatttttcaaagctactgaaatgttgaaaaaatagtacagtgagcacccacgtatgcatcaccagattctctgtcaacatcttgccacgttagctggctctatctgtctatctatctatctatctgtatatctatccatctatctatctatctatctatccatctatctatctatcatcttcctgaattgcctgaataacctgctgacatcatgacactgtaccccacatccttcagtgtgtggcccctgagaacaaggacatcatctcccacaaccacatcctccaccatcaccccacaagacattgaatctggatacaataatgttatcctatataaattgatatttgaatttcttccaaggtcccccaaatgccctttatagatgtttcttttctttaaacccaggccctgccaccctctccagctccccaacacctgctttgggcccctccaatcccactacattccagcctgaaggcctttgccctggctacgccctctacccaggtcatcctccccttcctactagcccaccaaccttctctttcttgttctccctctctctctccctccctccctcccttcctcccactccctctctttctctctctttctcgttctctctctccctttctttctccctttcacccaaagggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatggggtatgagtatgcatccttatcctcacactgttggctgaagtgcatgggtgggtccccaggccccatatgaagttgtccaagacagggagggtggtgagattccccggagaaagaagggagtctgggagaatcatttgcctatgaggagacacagaacaggtaggacgtggagtgtccctggagaagggaatctgggagatttgtcctttcacaggactgtaagggacaggttgggcatgggctccccctggaggagggagcctgggagaatttttccaccatgagactgttgtaggacaggaggaggtagaaccctctgggcaccttggacccccttcccctgtcccccatggtctcagaggccatgagtgtcatgggaccaagaccagcacctttttcctcagtgagatgcacatggtagacaccgtgacatggcacaagatgcgaggtaggtagccctgcccctctcacctgcccaacccccctgccccactcctcgtctcctaactgcccccaccctgtgcctttcctctcctgcttttctccctcacctgcccaccccactggacgtgcagacctcacattactcttgggtccgtgtctctttccaccgtgcattttcccgaagtctgtctgtctcgtgtcatgtatgtgcctgactctctggagtaagggcatctatctgtcctgggcttccttgcccacctgcctatctgtcccatgcccacctatccatccttgtgcccgcttttcctaccacatctcacctggtgcacctcctccttgccatgctgatctgctctctgcccatccacttgaccatgggcaccacacataggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactggtgaggtcctgagtggatgggtgggcagggactgtgggagccaccctggggcagcactcatggagtgcttgatccctacagagctgccggtggctgcagaaggtggcccggagcctggcactggccctgctgtgccttgtgctgtccacttgcgtgggcccctacctcttcccgtacttcatccccctcaacggtgaccgcctccttcgcaagtgagcacagccttcgaggcccctgcccagcaatgagggggttgggtagggacccgcggtttccccagttctgagcctgtctcttaatgcttctttctgtcttctgttactacagcaagaaacgcaaagccaggtaaatgagggcaggtgtgagggcacgtggagtggggctgacatgagtgggggcagagcccatgaccaatgggttctgtgtgtccaagtgtgtctgaccgtcaactccatgactagacagagactgtggttggctggctggctgacgaagcttggctctgtgactctgtttgactgacactccaacacatactgtctctggctgtccatctgttcagctgtctcgctgttagaagcaagtcatattaactgtcatggagagtgacaagtatgtgttggttgggtgactttaacctgtcagtgactctgtctagggatatgtatgatgtatgtttgtctattggccactgacccccgaatgtaagcctgtgtggctgtctggctgtgccatcatcagtgatagggtatgtggctgtcattggataagataaatctgtgttcaagattctgactttttgtagctttggccaggaatgggtctgactgtggcatgtcatatgcctgtctgtggagttcatggactacctctgcctgtgtgtctgccttccctgatggcttggtgttgtctagctgaggggttgtacccgactctggtctgtgcctgtctgcaggactgactgcctctagtttgactatagggtttgatctggctctttggttgtatggcccctcccctactccctggctgctgattaggtctaatgccgaatgagtctccaaaaggtcaagtgacttgaccagtgtcacccagctaagcagccaggcatgaatcccaggcctaacttcagaacctatgctttttccaacgcaggatgctgcctgtttttgaccatgtctgattacaactagtagggggggtgtgtgtgtgcacagcagggtgtttgatggtctctgtgcccagctcagggatttttggctgtcctgtagtcgctgagtcaggttagagcattgcaaggctgggagtctgataagatttgtgtctggctgttagagggtgcaggtctgtgaagtcgggcctctgatggtggctggctttggccgtctggccacgtgagcctgcagggccatgccatattataggatagctcatgcatccatttgagccacataagactaactgcctgagggtggatgtctgtgtgtgactatcatagttcaccttttttgtggctacatttcatctgtcttgtctgaacaattcagaccagcctccagggcctctctgactctcttttctttcttctctgctgccttcctgacccctgggggccctaggggcaccatggtaaggtgagtctacagagcggggcccaggatgctgacatgtggtggggtatcatgttgggacctgaacgtgatgcctctcacccctgcccctttctccccaggtggctgcgagcctacgagagtgctgtctccttccacttcagcaactattttgtgggctttctttccgaggccacggccacgttggcgggggctggctttaccgaggagaaggatcacctggaatggtgggggggcttggggaccccctctcccacagggtgctgcctagaggagctgcagggaggagggcgggtgctcccaggggagggaacggccaagacagaagtgtggcggtcagatgagttgagatcccaaatggatttgcatatctcttctgcccccagggacctgacggtgtccaagccactgaatgtggagctgcctcggtcaatggtggaagttgtcacaagctggaacctgcccatgtcttattggctaaataactgtgagtcaccaagtcaccactccagctgtgttggtaatccaggccctttcatacattcatacaacatttactgagcaccttctgtgtgctaggcacccaaaatccctacccttgtcgagctgcagttctcctgggggggcagatgataaatacgagaaaaaaaatacataatagctcaggtgttgataagtgctatggttaaaaaaaaaaatttttaaaaaagcaggtaaaggtgatccaggagtgctggcaggagataggagtggggagggtagggtattgcaattgtaaaaaaattagccagggcaagtctccctgaggaggtgacattggagcaaagatgcaaaacaggtgagggagcagggagcgcagatatatgggggaggattgtaacagatgcggggacagcaggtgcaaaggtcctgaggcgggaacttgcctggtgtgtggggaacagcaagaaggccagcagggcaggagcagagtgagccagggtccagtggcaggcggtgaggtcagggaaggcccggagggcctcatgggccatggagaggactttggctttttctctgagagagatgagagccacggcagggctctgagcagaggagggccctgggctgactcgggttgcagcaggatccctctggctgctgtgaggacagactgagaagagggatcgaggatgcagcagtgaggaggccgctgccatcatccaggccagtgatggtggtggtggcagtggatgtggagaggagagctcagattctggcatattctgaaggtggaactcacacaatttgctgaatttggatgtgggagtttggggagggcaaatcaagggtaattcccaggtttttgccctgaggaactggaaacgtggagttgacattgactgaacttgatgagactgggaggagcaggctgggaagatcgggagctgggctttgggcatgtgaagtttgaggccatctaaggactttatcctgggggctccaacaggttgtgggtattctcatcctgctgatggccctccaggaggggctgggggactttcaggagaattttatcccacatctcttcccctccagatgttttcaagaatgctctccgcctggggaccttctcggctgtgctggtcacctatgcagccagcgccctcctacatgtgagcagggtggagcaggatcagggtggaagctgggtgggggcgggtggcagggcctcttcctcactcatttcattgtcatctgcattcccccagggcttcagtttccacctggctgcggtcctgctgtccctggcttttatcacttacgtggagcatggtgagtgcagggcccagcccagccgttggatagaaggttggtgggggggctggagacagcctcccctgaggctaacctgacccccttacctctccccaccaccctagtcctccggaagcgcctggctcggatcctcagtgcctgtgtcttgtcaaagcggtgcccgccagactgttcgcaccagcatcgcttggtgagggttcagcctgggcaaccttgtgcccaacactccctgtcaaaaatgttccttctatctctatcttgtatgtgtctcagggtgcccaccttcttcttttggtgcctgagccatccccataacctctcctctattcgctggcatccgtttccctaacaggcatttatcgagcatctgctgtatacacacctggcattcgtttcccccagtgaacatccgttgagtgcctgttggtgctctaggtgctggagacacggtgaatgaaacagactgaagtcccagccctatgggacaaacattttaaccgggcagacagtagataaaaaatgagtcagtaaagtctaataatagtgtgtcagattgcaagtagtgctaaggagaaaatgtgtagggcaaaggggacgggaagtatgggggtgatttccatttgaaatagggaggtcagagaagcctccctggtgaggtgatgtttgaggcctttaaccgaaggaggtgagagagggaaacgttccaggcagagagacacccagtggaaaggccctgaggtaggagagggcctggaatctttgaggaatagcaaggcagccagggtggcttgagcagaggtagggtgaggaggggagatgggtgggaggcatgggccctctagatcatggtggggatttggttttgttgtgtgtttttcattctgtttgcaataagaagtacagacaacttcatacttgtctcccacccaactcccgttcattactataaagccctgactcaaagccctgccactcttcctcctctgcctggagactcgcacctcccccaacccaggatgccctcactgtgaacagtaccctcatcttggatgcctctgcataggaggctccctgaaccatctcttccctatctcagggggtaccctgggcatcctcagtcctggaacccactgtgccctgtgtgtcccctgggctcccccgtgcaggaggaggtgggacacagtgagtaggtccagttgccaagtatatccatctgtcccccacagggcctgggggtgcgagccttaaacttgctctttggagctctggccatcttccacctggcctacctgggctccctgtttgatgtcgatgtggatgacaccacagaggagcaggtgaggtggggccctgggctgtgtggttaaccaagggtggcgctatctggcggggggaaaccatgaggacaaaggctgggaagctgaggcctgagctcctcagactgtgctgcttcgcctgggcagccagtgctcctcggtcctttcccatagtccctctgcttgagtcacactgttaggtcttttatttgggtgaagtgtgcaaaatatgtttatttattttacttataaaataacttttaggctgggcatgctggctcacgcctacaatcccagcactttgggaggccaaggtgggcagatcacttgaggtcaggagttcaagaccagcctggccaacctggcgaaaccccgtctctaccaaaaatataaaaaattagccaggcgtgatagcatgcacctgtaattccagctactcgggaggctaaggcaggagaatcacttgaacccaggaggtggaggtcacagtgagcccatgccactgcactccagcctgggcaacagagcgagactctctcaaaaaaaaaaatcactttatagagatggagtggaaaatccaggttttacttgtgttaattatttcacttcattattgtttaggtagaatttgcaagacttcttaattttttttttttttttgagacaaggtctgtcacccaggctaaagtgcagtggtgtgatcacggcccactgcagcctcacattcctgggctcaagccatccttctgcctcaacctcctgagtagctgggactacaggtgcatgacactaagcccggctaatgtttttttaattttttttgtagagacagggtctccctatgttgcccaggctggtcttgaactcctaggctcaagcaatccccttgcctcaacctcctaaagtgctaggataacaggcatgagcaccctgttttatttaatttaaatatatatatatatttttagacggagtcttgctcttgttgcccaggctggagtgcaatggtgcgatctcagctcactgcaacctccgcctcctgggttcaagcaattctcctgcctcagcctcctgagtagctgggattacaggcacgcaccaccatgctgggctaatttttgtacttttagtagagatgggatttcgtcatgttggccaggctggtcttgaactccaggcctcaggtgatccacccgcctcagcctcccaaagtgttgggattacaggcgtgagccaccacgcccggccaaaaaaatatatattttattttacttaggttgagtgtacaaaccctggattctgcactttaaaatttttcgttaaaatgtatgcactatttttgttcatgttgagtatgcaaataccagattttactcctttttaaattaagaacaatttaaaaataacatttattcatatggctcttgcagaatccaggtttttgcttctcttttagttaggtttcagtcaaaaacaaaactttgtgttttttgatattaaaaagtttttaattcaggttaagtgtgcaaaatctgggatttgcttttcttttttttttttgagacacggtctcactctgttacccaggctaaagtgcagtggcacaatcatagctcactgcagcctcaaactcccaggctcgagcagtccacccacctcagcctcccaagtagctgggactagagatgcatgccaccacacctggctttttgcttctttttaaataaagtttttgttttgttttcattaaaatattttaaaatagtgaatgcctatcatgtgcttcaaaaaccaaacagtattcaagatatttagagaaaagatttgctcccaccctctgccccctaccctcttacaggttacatggtgagacggggtttcaccatgttagccaggctggtctcaaactcctgacctcaggtaatccactcacctcagcctcccaaagtgctgagattgcaggcgtgagccaccgcactgagcccacttttatccttttattaaaatatctttccaaaatttaagcatatcaaacaaatataaaaatatattttaattctacccccttgccagtttttaccctaaagataacacatgaatgatactgttctgcaatttttgaaaatcttccacatcaggatatagtgtcctcattcattttttccactatgaggaagtgacacagtttattttttctcttatttgtggacatcaggtaatttctagtcctttcctattgcaagtgatgttgcagcaggaactctgtacccaagtggatccacacaggtgtggacagatctgtaggatctgttgatagtctcaatggagtagtacttttgtgctctcccaccagcaatgcctgaatgtgcctgctgccccaccagtacagagtgcctctcagacttcctggatatgtttgccacttcaataaagaggaagatggccgggcggggtggctcatgcctgtaatcccagcactttgggacgcccaggcaggcagatcacttgaggtcaggagttcgagaccagcctgaccaacatggtgaaaccccatctctactaaaagtacaaaaattagctgggcatggtggtgcagcatctgtaatcccagctactcaggaggctgaggcaggagaatctcttgaacctgggaggtagaggttgcagtgagctcagatcgtgccactgcactcaagcctgggtgacagaatgagagcctgtctcaaaaagaaaataaataaaatgaggaagattattaatgaggctgagcatcttttcatatgtttaagagccatttgtttttcctttactggaatgacctattcaccttctctggcaatttttctttccaaaaaattaatttttaggagctctttatatattagggagataacaggtcagagaatgggatcactttgtttttaaaatgatttttaaagaagaagacaaaaactatatctggtcacctttcatatgtacctaggcccttctgcggggcctcgcctagagcagtcacagaaatgtccttgggcaaaggatgggttttcctaagaacttctttgtccttgctaagtgggaccatcacctctttctctcccacagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 2289 - DNA, 11032 bp, Homo sapiens; identical to SEQ ID NO: 2288

SEQ ID NO: 2290 - DNA, 11833 bp, Homo sapiens; identical to SEQ ID NO: 2286

SEQ ID NO: 2291 - DNA, 12277 bp, Homo sapiens
tctcgcgaggccggctaggcccgaatgtcgttagccgtggggaaagatggcggaaaatttaaaaggtgaagcagtggaggcagaggcgcgggcccgctggccgggccgggtgggctggaggggtggcgttgccggctcggggccccggcgtccgaggccccggcgccgggagccggaagctcggcgcggaaaggatgaggctcggggagcgcgggcctggtgcgcggggctgggcggggctcaggggagggggcgcgcgcctcggaacgcagcgggcctggggctaagtggggacgcaggaggggggcgcgcgctgcagatcgcggccggaccggcgcgcgcacgcgcgggggcttgtcgaggaggccgcgcccgcgcgcgggaaaatcggcccctggtgaccgttacccattcggtgtccacgcgagacgccggaaggggagggaagataagggggacagacccccccttcagagtgcggggactgagaactcttctgggggaaagtatcgcctctcggcgtgatgggggaagggtttggaatagaggatctcccagaagagagaaatggggccttcctaataggacagctggactcccccatgtgcagggaaagaggggtgactcagttatgttggggggcccctctatgtgacgaaagccgcagggaggatgggttccacaagtgggaggacctctgaggggttcaggagagtccacctgtggccagttccggagccagcagctggagggtgttaattgggaccacttaagtggggtttcaaatgcaagtgaaggaaggggtttgcgaggacaggctgtagggagaggaaagcgtgggcacaggcgggctcagtctccacttggtcttgcctaagtagggggggtagggcttgcacacgaaataattttgaaaagctcttgtacgtttttaggttgacatctaaagtttaggtgtgatttttgcaatgggaggcagaaaatattaaacattttaaaaagatgatataggatgaggactgactgcccttggaatgttttgagacatgatttgataaaatggcttctaaagtactttgattaagaatgtgccttgaatcagaaagaaatctgttttttaaaatccgtgtgtcttacaaaattttggcagtcccagaaatataccaggtatatttaaaagaatcagtgtcactaatctgtaccgctttgcgtataaattcagagcataaccctttggatgagctttactcttcacagaaagatggatgagacagaaagtcaaaatgcagtgtgaaaaaatataccttgtggatttaaggcacccagattgatcatttaaggagccttcctgtaatgtagtatcattccacaatctcttgctcataattccgaaatctaaaaagccctgaaaactgaaatccttttcttaaatttggcaccatttatggcaaaagtagattataaagtggaactcttctgtgaggctattttatatctctatttctcctatttaatgtgggaaattcatacttttgctgcaggacggttaatgcatttgattatagcttgatgtcccctggccacgctgggggtgttaggtgatgtatgggatatcctagaactagtcttgtaaaatccaaaaaattttgaattccaaaacacatctggcccaggagtttgagataagggattaaagaccagtctttccagttacgcctttgtttggtgccctggaggttttaatcttgtcctcccatccgccccacctcggggcactgcatcctactgagatggggggttgttctctttcttttgcaaagtggagagaggggtgatcaggtcctgaacccaaagcaggtttgcaggcagttttaggaatgacatggagtttgaagctctggaaatagattcctttaggacaattcatgttgcaaaccccgcttagaggtctgctgctccaggggcagctttgggcagtgagtattggggttcaaagcacatttctgttgtagaacagtctcagcactggggaaggcctgtggattaaatttccctgactcttagtcagtctttgggatgtcccagggaggatttggggtcccctttgactcctggcctagtcaggctgcccagtaatagttctttctgccccgcttgatccaggctgcagcgtgtgttgcaagtcttcttggaatcagctgcaggacctgtgccgcctggccaagctctcctgccctgccctcggtatctctaagaggaacctctatgactttgaagtcgagtacctgtgcgattacaagaagatccgcgtgagtctggggtgaccatgctctgggaggggacaggtcacaaggaagttagtgtcctgccctcttgtccccaactgcccacatctgtttccaaagggaattttctcctttgaccctgaaaacacaggatgaatagacccttttatccctatgttacagatagggaaactaagtagctttctgggcaggagccggaatgaattcccaaataaatctcttcccatctccctaggaatacaaagtaattgcagagattgagatgctgaaccctggagtggaaatgtcaatagctaatggctattgagcactttcagtgtgccaggcgtttcctctcggaaactcatttaatcccctaacaactgaaatggggatagttattgccagaagggggagtggcaggatggttaggagaacaaactggagtcagcatgcttgggttccagtcctggttgtgttaccccaggctacctacccaaaccttcagtacttcattttccttgtcgtaaaagagggataactaggagcatctacctcatgtggggttgtgaggattaagttagttaataatacatgtaagctgcctagaacaggcaaggacttgtcagggtccaggtgagccagggtggtggcagtgatgatggtttgtcactggacgtattttgaaggtggggccaacgggatgtgcagagggtgggtgtcggaagtgtgaacaaaagagaagtcaaggatgactccaggagttccggtctgaacagctagaagggagggagctgatgatggggaagaccaaggagaggagtgggtttgggagattaattaaaagttggaacagtttggacagacagtaagggggagaggaggatttgaacctagtaatcctcactctagagcccatgctttttaatcaccgcatgaagtcattccagaaaaggggtggggtggggtaggtgttatccatcagctttgggatggaagccccatgaaggctggcccaaagatctcactacttacggtacccccgtccccctacccacccccaacaggaacaggaatattacctggtgaaatggcgtggatatccagactcagagagcacctgggagccacggcagaatctcaagtgtgtgcgtatcctcaagcagttccacaaggacttagaaagggagctgctccggcggcaccaccggtcaaagaccccccggcacctggacccaagcttggccaactacctggtgcagaaggccaagcagaggcgggcgctccgtcgctgggagcaggagctcaatgccaagcgcagccatctgggacgcatcactgtagagaatgaggtggacctggacggccctccgcgggccttcgtgtacatcaatgagtaccgtgttggtgagggcatcaccctcaaccaggtggctgtgggctgcgagtgccaggactgtctgtgggcacccactggaggctgctgcccgggggcgtcactgcacaagtttgcctacaatgaccagggccaggtgcggcttcgagccgggctgcccatctacgagtgcaactcccgctgccgctgcggctatgactgcccaaatcgtgtggtacagaagggtatccgatatgacctctgcatcttccgcacggatgatgggcgtggctggggcgtccgcaccctggagaagattcgcaagaacagcttcgtcatggagtacgtgggagaggtagggagatgggacccggtgtgtgtgtgcagctcttcccaccctgtgttcacagtgtgcacccggctctcctcactgtgtgtctgaaactccctgctttccctatgggaaaggcctgggagactgatctgagtgtcacagggacattgggcaggggctagtattccaagctggtacacaccagcatggccatgctggtggttacaggaacaccaaaatacttctgcactgggttgactttatcagggtacttagcaaagaagaaaagtgggagctgagatccaggcagccttagcattccttgtaacaggccatgtggtctggcatagggctgcatcagctggaaaggcacttcctcttctcatttcacaagggcccatcttatcaccaagcagtatctgcctgaggagcattgttttaccagtctgcacagaaggaacgcagtctggagtaggatgagacatgccttggacaaaggttggctaactcctttagactttcaggacactggggaaggccgagtgtattaggcaagccagccattgtaaaaacaaccccctcatcttagtgactttgcacattacaagtttgcttgctcatggaacagtccattgtgggggtttgagtgggtatcctttcacacagcaactgggacacctaggctctttccctcctgtgcctttgctgtgccttgaagccttggagtcactaccagatcctcagcattgcctggcaggcgggccaagtgggggatagaaggggcccatcctagtgggccaggcctagatgcagcacccatcacttctgcccatgctccactggctggaactgagtcactggccttacctccatgcaagagaggcaacaggatgtgctttagccatgtgcccagctgcacaaggctaaagcacagccataactagcaactagataactagcaagtatctacaacagaaaaatgtcgcattctaagatgggatgcagttagcatttgggatgagatgatttttcgttatgtagaactgtctcatgcattgggggacatttagcatccctggaccttgaccatttaaatccatgagtgtgccctgtcatagtgacaaccccagatacctctatatatagccataggtcccttaggggtgtgatatagttggaaagtgacagaaactggcctgaggaacactcacatgagggtgtccacactgtagcactgatactgatgacaaggagaggctcctactctgagaaactgtacagagggtcacatctgacagggacagagacaatcttgggtagaacaatctacaccacagaggaccctgacagtctgggcaaggagacagccacaccctgtccagataaccctgctggcctgctggaggagatgtctacatgccacaggacctggccatctggaaggaggaggtggggaggtgtccacaccctgagggctcctgacagtgggcgggggaaggagtcctgataatctgcaggaagtccatgtcccacagtgaccccagtgacctggaggaagagcttgtgctctccacactctagaggacctggtggtctgacttaggaagtgttcacacccatgttgtcatgacaggaaaaagaagtgtcctcaccccagagggatccggacagcctggagatctagtctacacccaagggcaccctgacagtatcgggggaagtgtccatgccctcaatgtcctgacgctctggaggaagtgtccagaggttgaaggaacccaaactctctggaggagatgtccagaccccataggacccagacagtccaccgtcctaggggctgcacagagcaggaagtatctcagcctcactgtactggcatctggaggaaacactgtctaccacacagggtcctgacagtcgaggaggaagactacaccccaagggcagcctcagaccctcctgggcctgagacttttctggctgctcttccttagtgtcagtgtctttaatcctcccagggatcctctcagccctgtcctcacccttcctgctctccacacattcttgctgcactatttcctgaccgccctccagcaccctcagacccatgggtcctcctgatggtgccacaggcctccggaaagagccaaactcatcttcccgcattcccctctgaagagacagtatagcaaatggttaggagggtggactctggatcctgactgcccgaggctgaatcccagctccactactcatcagcaatcactaacctctgtgcctgcatttactatgtaaaatgggaacaataatagcactcacctcacaggcttgttacaaaaattaaatgagttactatgtatcaagcacttggaaaaagcacttgaacagtgttcagtacacagtaagtttgatacaaatgttatcagcatagttcaaacttcagcaaatccaaaatgtctggaagaccaagtttttttgtaacccatctggctacaggacccagcctgaccggatagggtcctatttgtagtttttatttatcctacttggggtaatagtcatacatttcgttgcagcagttctaatttacttgattctgtagtgccgtcccagatgctgccagggtgttacggaatcaagggcctatctgcacaccatgctatctactgtccttcttcagctgggacatgtactgacagtctgtaccaagagctccctccacgggagctgcccttccctcctttgcagcctcccacattgggtcagaactttcacgttcctgcagaacattcccatcctcacccaagagacaatgccagcctattttatccattctaaaacatgcattttcttcctattttaacatctcggaaatgaagatgtcttaattaaatcatggtgtatcatttataattaacagcagtttttcctttcttggtaaagggcacataaaattaagggtgtgccttacatttataactggtcctcataaccactcctaacattgctcactctcctatcagaaacaggaacacctttcacgtccatgatcttgtatggatctttacaacagcccctgtcaggttgggattttgtcactgtcattcccattctgcagatgagaaaactgaggcccagagaggtagaataacttgattaaaatcacaaaagtagtacaatggataaaaaaataaaggcccaaataatatctaaaactggtaccctgccaggctgtagctttttttttttttttttagctgaggaaacaggcacagagagaacattcaggatcccatatccaggagggggcagagcagcagctgactccaagtcttctagttcccattcacgtcagcaccctctcggaactgccagcttacagcctgtcttttccattcattctggagagctgttagggagcagagacaggcccatctgttcccaagctttcagggttgaccaatcattagagaatgggactgaaaagaagatgagaaggaaccaagaagtgtttgtgccctggagggcctgcagtatgactcactcctggtgagactgggagagcaggtagtggcagaataggcatgaagatggagactaggaaggatgtgggcactcctcctggctcaaggagggcctacggtgaaaaagatggctcataccccacccactaggcctgtgagcctgggagaggctgccctttgatcccaggacttgatcagacaagtggccagcttctgaggtaggggaggaacgggaagcttggaaggctgcctagagaggtcccatctgtttgagctgatgccacaaggaagactgttctccaggaggtgaagggagactgatcttgacatattccaccctcatgttgtggcccttaggagagagtccccactcttccaccaggtggtaaagcccttttatgatctgcaactcgttttagagaatccgtctcttctccattccccctcaagccctaagcactgtttcctgatcacagtcttacactgtgggtgtgtgaatctgtctctctgtgaccagactttgaccccttgagggcagggaccaatcctggttcctgtgtatcccctacccacctgtgacccctgagagtggaccgggcctggtccctgtgtctccctgatcagaccgtgagccctgcatgctgggactgggcacaaggaaggcctcaataaaaaccctggcaagggagccaggttcctcaaggaacagaactggagcacggggcagtgggtagtgtggcccgaggcagggtaaatcttggtttcctcaaggcattgttagtcagcctttggcatggaacacagccttgaggggacagccagggagaacaccagtgtggccatcctagctaaggagatggattcccaagtcagaagggcatggtcaccggcccacatgagggtgagcaaggaaggaagcccgagaggggtctctggagaagggaggggaaggaagaagtgtggcgggggagtactggagctacctggagggccgccacttggacagaggacaggctgctaagccaggaagcagaatcaaagtaaacagcagtccccatgtgtctcctgtgtgctgtgcactgttcttggctgaggtacagtgggacccctacccagggaagggcctggtcagctacgcttggggattggcaggaggctgccgttgctggcctcagggaagaggggccatggggccggagatttgttggcgtggattgggaggcaaggacaggctggggctaggatggcagcaaagcttcccatttcctaggacaggtagggaaccagctggggaggaggcacccactgccgtctgaagcaccagttggcactgcgcagccctgggccgagggagagcttctctcactgtgctctcccttcatctttcctcctcctctgctgctgtctctgaagtgtgtggcctcagcctctttctggctctctgaacctgggcctccctctgcctctgcctccacctctcttgtcttgaggcccttgccccctttccccatggcctgggtctcttcttcccctctctccacgccctccctgctgggtcctgcatgggctcaggctcccttgcctggatcagtaagtatctctccctgtggcaccctgggtcactttctttcttgcccttgctttggtctctcctgatcaccttcctgctccgtcccaaggcactggaggctccaggggttcttgggcagctcttgctgggtggcggcaggaggtgctcgcgtggccccagttgggccctgcagccaggccagcctgcactcaccgccagggactcctcctgctagccagaggcctgaggcgggccaggcagttgccagctgaggcccagctcctcaggaagggccgacagactctctgcgtcactgcccatgtgtgtccacgggcaggggtgcctcctgctccctgtccttcagaagtcaggagcagtgccggctttcctgagacttcgcggccaatctccccttacccatggccctttccctagatcattacctcagaggaggcagagcggcggggccagatctacgaccgtcagggcgccacctacctctttgacctggactacgtggaggacgtgtacaccgtggatgccgcctactatggcaacatctcccactttgtcaaccacagtgtgggtacccccggcaggcgggcaaggggtcgagaggggcaggctggagcccctcctcactctcccaactgttctttctcgcccagtgtgaccccaacctgcaggtgtacaacgtcttcatagacaaccttgacgagcggctgccccgcatcgctttctttgccacaagaaccatccgggcaggcgaggagctcacctttgattacaacatgcaaggtgggggtggcaagggactgggggcaggggcgcactgtgacttgggacacaaggacccctcccaaaggcacaccagtcactcagagaaccaaggaaaattctttagcgggagctttaagatgctcttcctgactcccagtcccccattcggactactagacccctgcctacccctcgagtcccctcattcccagcccctgaaccctaaccctgaggcattcataccaacttctcccaagattcctggagagttaagaaactcctgactccagtcttgactgagtttccctcatcccccagcccctccccactcctagctccctttggccttcttcatcccaagcctctggacacccttgtggcctccagccagtcccctccttgataagctagccacctctgagaccctcaagggcaggtctttggcaggagagttcagatgtacctctggatgcccaggtggccctctattcctgcccctgcccccccccacacacctaaaacgaccctcctggttccttgacggctccctgcctcccccagcattcttcaacccctggcctgaacaacctccagtgctgagccctggccctagccccaaaccaccaaccctaagatctcccaactcaaatcccagagttgctcccagccccaaagatccttggtctcatggtataaagggtagtgggacccttcatccaggccttctaacaagtcccctgcctccttccctaccttcctccctccctccttctccccctccctccctgcctccttccctcctctcctccctggctgtgactccacagtggaccccgtggacatggagagcacccgcatggactccaactttggcctggctgggctccctggctcccctaagaagcgggtccgtattgaatgcaagtgtgggactgagtcctgccgcaaatacctcttctagcccttagaagtctgaggccagactgactgagggggcctgaagctacatgcacctcccccactgctgccctcctgtcgagaatgactgccagggcctcgcctgcctccacctgcccccacctgctcctacctgctctacgttcagggctgtggccgtggtgaggaccgactccaggagtcccctttccctgtcccagccccatctgtgggttgcacttacaaacccccacccaccttcagaaatagtttttcaacatcaagactctctgtcgttgggattcatggcctattaaggaggtccaaggggtgagtcccaacccagccccagaatatatttgtttttgcacctgcttctgcctggagattgaggggtctgctgcaggcctcctccctgctgccccaaaggtatggggaagcaaccccagagcaggcagacatcagaggccagagtgcctagcccgacatgaagctggttccccaaccacagaaactttgtactagtgaaagaaagggggtccctgggctacgggctgaggctggtttctgctcgtgcttacagtgctgggtagtgttggccctaagagctgtagggtctcttcttcagggctgcatatctgagaagtggatgcccacatgccactggaagggaagtgggtgtccatgggccactgagcagtgagaggaaggcagtgcagagctggccagccctggaggtaggctgggaccaagctctgccttcacagtgcagtgaaggtacctagggctcttgggagctctgcggttgctaggggccctgacctggggtgtcatgaccgctgacaccactcagagctggaaccaagatctagatagtccgtagatagcacttaggacaagaatgtgcattgatggggtggtgatgaggtgccaggcactgggtagagcacctggtccacgtggattgtctcagggaagccttgaaaaccacggaggtggatgccaggaaagggcccatgtggcagaaggcaaagtacaggccaagaattgggggtgggggagatggcttccccactatgggatgacgaggcgagagggaagcccttgctgcctgccattcccagaccccagccctttgtgctcaccctggttccactggtctcaaaagtcacctgcctacaaatgtacaaaaggcgaaggttctgatggctgccttgctccttgctcccccaccccctgtgaggacttctctaggaagtccttcctgactacctgtgcccagagtgcccctacatgagactgtatgccctgctatcagatgccagatctatgtgtctgtctgtgtgtccatcccgccgaccccccagactaacctccaggcatggactgaatctggttctcctcttgtacacccctcaaccctatgcagcctggagtgggcatcaataaaatgaactgtcgactgaacaa

SEQ ID NO: 2292 - DNA, 7633 bp, Homo sapiens
ttcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttggtgagctggggatctcctgcccccgccccgtccccaccgtttcttcctcttcctctcctccttctctctcttcccctcctcccgctcctcctttccctctccatcatctcctctcctagaatttcccgtcataatccacccttcccaggaagatctcaatgtctacttgccttccctctggctgcagctcttcctttgggcccatgactgtcatgaggcaggaaggaccaggtctggctccaagaccttgtggctacccctgaccagactccactgacccctgctttcctctcccagacgctggccactgcagttgttcagctgtacctggcgctgccccctggagctgagcactggaccaaggagcattgtggggctgtgtgcttcgtgaaggataacccccagaagtcctacttcatccgcctttacggccttcaggtgacccccccacccccgactggacttgcaagccagttctcaacccgcaaacccagatctgtgtccatatgtgtccatagcttcaagacctcagacctgatcagtgaatccctgagccccagaaccaaagactcatccagatggcaaactctgacttgcctttctaagtctgcaatgactggccccagtctccgtatcaagatctctaaagcccccagtattagtctgctgcctaagcctaatcttttccacaaattccaataaatgagcactgtatttgtacctgaacctcaaatctattctaaactcaacattttgcatcccaggaatctctcatcaaaactcctgaaccccagatgtttgccaagctcctaagtcataaatctgttcaacaaaccccaaagttgaatattccattgatccttgaactccaaatctgtccttctaaatccacagcacagaccccagagttcccatattaaaattcctgaacactcaaataccgaggtagttcttaagcaaaaagtcttttccacaatcccctgacctgaactttctaggtttaagccccaaattcatccttttaaacccataaagatggacccagcataacttccagatcccaaggctatcaaatatccaccaaactcctaaaccataactctctccacaaaccccaaattgcacttactttagctggactccccgcgaaactcccaagtctatgtgtctgaacttcaaatctcaactccaacccccaaatactagaatcctacctgtcatgaattggggctggggtggtgggggagggcatggattgaatctgtgaatgagcctcaacttcctaagactagagtcctaaattatgaaattcaagcccccaagtcccagatctagggccccaaaccccaaatccaaacctctcacaaaagtgtatggctcccagactataccccacaatccacacccttagacaccaactctctggtgctgagctgaaaatctccaaaccagactatgaggctcccaaatccagacaccctgctccctgcccagctaacaaaagcctgccacccccggcgtgcctcagtgccactgtgcctcccaccctacacctctccaggctggtcggctgctctgggaacaggagctgtactcacagcttgtctactccacccccacccccttcttccacaccttcgctggagatgtaagtgatcaaccagccctcgggcctcacttggggtgtggagaggagatgggaaagttgcgggggacctgggaggcggctgaccccaaggtatgtgcaggactgccaagcggggctgaactttgcagacgaggacgaggcccaggccttccgggccctcgtgcaggagaagatacaaaaaaggaatcagaggcaaagtggaggtgaggaggccacaggggaggaaaggaagttgggcagaggtgagtgcaagcctggggaactagaaaagtcccctctcatggtcctggctcccaatccatctatccacagacagacgccagctacccccaccaccaacaccagccaatgaaggtgagtcctctagtgcaagtaggggtaataaggggctagcccaggaacctgtggcagggctgtgataactctctacacattccatcttcccagagagaagaggagggctcccacccctgcccctgcatccaggtggagaccaaggaggtgcgtgctgattcttccctgtgtctctggatggatgggtaagagtggatggaggaatgaggagttggatgggtgcgtaagtgggtgaatggataggtagattgataggtatgtggatggacgagcaggtgcatggatgtgtggactgatggatgggtggatggattggcggtagatggctgagtagagggatgaattgatgggaggatgaaagtctaagtagatagatgcataggtgaatgggtatgtggataaatgaatgaaaaggtagatggatgactgagtaaattaatcaatgagtgaatgaatgaacagtgaataaatgactaaatgacaagtttcagtcagtgaagaaagcatgattgaatgaataaatgagtaaatgaatattttaacaaattcattagtcaatgagccagtgaatgataaagcatgagggaatgaaaacatgaatgaatcagtgaatgtatgaatggtttgtgggatccacccacttctccatagaccctacttgaacccttcacccactacctccatgaccatccaacacacacacagatttccctcaaggcttccgtttcttgcccctgtgctttggttggttggtaagtgggtcaatgagccaaccaccctattttccccacaggccctccagtgggtccgctctccctggggctggcgacagtggacatccagaaccctgacatcacgagttcacgataccgtgggctcccagcacctggacctagcccagctgataagaaacgctcagggaagaagaagatcagcaaagctgatattggtgcacccagtggattcaagtgagagccactccccagtggacccacagattcctgggggcagaggggcacatgaacaagtggacagctgagtgaatggaaggatgggcagatgggcagatggctgggtggctgagtgggtaaatgggtggttggataggtaggtgcagggctgggtctagggagaggtaaataaggcaccaagggtacaaaatttaaggaggcactcactctcagaggcatgcaactgtaattcctgactctcagagtgagtgactcacttaaattttgcaccctaggcaccttacttgcctcaccctgggcccactctgggtgggctgttaggagagcaggtgggtgggcaggtgaacaaatggatagatagatgaggtagatgatggatgagaagggctggtgggtaggtgggtgagtggatgggtggatggatggataaatgaatggatgaatgaatgggttgaagaatgaatggataagtggttggatggacaagtttatgggtggatgggttgatgggaggtgcgtggatagatagatgggtgagtggataggtgtgtggacagattgatatgcaggctgattggctcacagacaaggtggatggggatggacaggtggacagatacgtggatgaatggacagttcaatggataagtgaacagaagtgtgtggttgcatgggtagaaaaatgagtggatggatagatggaaaggtgggcacatgggtaggtggatgggtggatggacaagtgtgtgtgaggacagactggtggacaaatgggtgaacagacatatgtgggcagatagttgcagagacagatgtatggacagatcagtagtccaacagatgaatgtgaatgaataggtggacaaatgcatgggatagatggggaaagagggatgggtggatggatcagcaccacaaactatggagcccttctaattccataactcctgcctatactcattcactcattcagtctcattcattaattctggcccctcagagtctctttgggcaggagagggcaagagggtttcactatgaagggagggaaggaagggcagtgaggattcactggagtctcttcacctctcccaggcatgtcagccacgtggggtgggacccccagaatggatttgacgtgagtaacttcagagtctcttggactccactaaacttccacccacccttccaaagaccactgctgagaccccacccccagatcgtgcccttcccacacccctctcagatcccttgctgggatggacccaacgacaatccatgtcgcttgtctcctcgccttattcctctactcctgcccctggcctttttcctcctgggcaggtgaacaacctcgacccagatctgcggagtctgttctccagggcaggaatcagcgaggcccagctcaccgacgccgagacctctaaacttatctacgacttcattgaggaccagggtgggctggaggctgtgcggcaggagatgaggcgccagggtgagaccctgcttccatacgctcccttctctagcccaagcagctcatagctaagatacgcactaagtcactcagtccttatgggagcacctatactgcttcagtcaggagttggtcagtgggggtacccattttacaaatgagcaaaactgaggctcagaagaaatcaatgagagttacagctatgtgttataccccctccacagagccacttccgccgcccccaccgccatctcgaggagggaaccagctcccccggccccctattgtggggggtaacaagggtcgttctggtccactgccccctgtacctttggggattgccccacccccaccaacaccccggggacccccacccccaggccgagggggccctccaccaccaccccctccagctactggacgttctggaccactgccccctccaccccctggagctggtgggccacccatgccaccaccaccgccaccaccgccaccgccgcccagctccgggaatggaccagcccctcccccactccctcctgctctggtgcctgccgggggcctggcccctggtgggggtcggggagcgcttttggatcaaatccggcagggaattcagctgaacaaggtgaggacaggcaggatggaggattgggggtctaggactctggggtgtcccgtctaagtcaggatactggggggctgaggccaggactgaggagagtgccaggccttagggattcagtgatagggttgaaaggttggtgggaagccttgaaggggactggagtgtgtgggagagaaaatattgatggaggggcggggagaaatgctcctttcccaggccctaagccctctgtgctgatccctgcctgctgcagacccctggggccccagagagctcagcgctgcagccaccacctcagagctcagagggactggtgggggccctgatgcacgtgatgcagaagagaagcagagccatccactcctccggtgagctgatcctgccggggcctcaaacctggctcccagggctagcactggcctcaaaacaatcccagcagtcaccaccaatagtgacatcagccccatctgtttgacagcattaacatgaatcttgtgtcagcctcgtttttgacaatgttaacattaagtcattatgtgacaataatataattaactccaactttgacagtaatattaacattaatgccagggtgtgtccacaatattaatgtcattcccacatgttcagtactactaacatcagctggccgggcgcggtggctcatgcctgtaatccaggaactttgggaggctaaggcaggaggatcacttgagcccaggagttcgagaccagcctgggcaatatagtgagacctcgtttccataaaaactaaattcaaaaaaagtagtcaagcatagtggtgtgtgcctgtggtcccagctacttgggaggctgaggtgggaggattgcttgaccctgggaggtcaaggcagcagtgatccatgattgtgccactgcactccagcctgggtgacagagatcctatctcaaaaaaaaaaaaaattaacccattatgtgatgacaatattatgaagaacactattgttgacaatattaattttaattccatgtattaacagatttacattaattcattatgacgtaacctaatctaatcttttaaaaaatttttttgaaacagggtctcgctctgtgtcccaggctggagtacagtggtgcaatcatggctcagtgcagcctcaacctcccaggctcaagcgatcctcccgcctcagctcccaaagtagctgggactacaggcgtgtgccaccatacctggctaatttttggtgtttttttggtagtgatgagctctcactaccaagctctcactactctcatgttgcccaggctgctctgcaactccagggctcaagcgatctgccccgcctcagcctcccagagtgctgggattacaggcatgagccaccaggcctggctgttaacctaatctttttataataatgttactattactctcttaatctgtcagcaatactgtcactaatccattatatgatgcaaatattagtatcaacctactataggaacttcatctttcgacaatgatttttttttttcttttgagacggagtcttgctctgtcacccaggctggagtgcagtggcgcgatcttggctaactgcagactctgcctcctgggttcaagcgattctcctgcctcagccttccgagtagctgggactacaggcacgccactacgcccagctaattttgatgttattgtcattaaccccattatgtgtcaaaaatattagcgttaaccagacaggaagcaataatatattatcacacctttgctaatattatttaaattcaccctattatgtgataaataggttaacattaaccctttgtttgacaatatctcgactaaccacatttttgacagcataaacttcaactccaactagaactcagaccccaactataatccctttcttgtcccaaatggaaactctaacttgccctcctctagcatgagacctcagaaccccagggtccagtcctcacctcccaggccctatgaagccccccaccaacctcccagggcatcttatctttctctttccctccagacgaaggggaggaccaggctggcgatgaagatgaagatgatgaatgggatgactgagtggctgagttacttgctgccctgtgctcctccccgcaggacatggctccccctccacctgctctgtgcccaccctccactctcctcttccaggcccccaaccccccatttcttccccaccaacccctccaatgctgttatccctgcctggtcctcacactcacccaacaatcccaaggccctttttatacaaaaattctcagttctcttcactcaaggatttttaaagaaaaataaaagaattgtctttctgtctctctataa

SEQ ID NO: 2293 - DNA, 7737 bp, Homo sapiens
ggacaccccctgggatcacactgagcttgccacatccccaaggcggccgaaccctccgcaaccaccagcccaggtcagtctcagcccccagagagcccccaccaaggcaaccctgggcctgctgcccctacccttatgcttgctccaggctccccaacccacagctggtccccaaagtgtcagccagccctgaatccctttacagctcctccaacccacctgtctttccaactcccatttctaccccaaatctaccccctaaaccccacctctttctgccctctcatccactccgtccaagatatctatatcctctggatcccttcactttgctcgctatacccctaggtctgtctcccctaaacactaactctgtctcccaaaacatgactttatctccccaaatcctttccctgtcccatatctgatttccactcacccaaacttgtctctgtctccctgacttctcctccaaacctcacttttctgctcccaaaccccttatctgctctacaacgccttgtctttgccccactctctctgagcccccaaacctgtctctgatctgccaaaccctagctccatcctcttaccaccatctctgcctttcaaacccactctttgttcccaatgacttctctctgatctccgcaaaccatttatctctcccaactccctgcctgctcagtaaaatatctttgtcacttcaaacaccaagtcaactccccaaaatctgttctgccgcatgaaccctcatgtctgccttccccaaaccgtatctcagccctaaaacacatctcattgtctccctgaatctctccagctccaagcctttctctactccaattctatcttggcttctcaaactcccctttactagccacattctgtctgcccaaacagatctttgactcctaaactccatctctcctccagaaaaacccttgaactccccagacttttctatgaccctcagaatctgactcccacactacttctcaactttatttctgactctcaaacttcgccccgatcccccaacctcgtctgttttcacaacctattcctgagcccaaaatgtgtctctgaacttccaagctcgtctctgctccacaaccccgcccatatctgcctccccacaaactccatggctacaccccaaacctctctgacttaaccccatatctgaccttcaaattccacctctatctccccctaagccccatatctgccccctagaccttatatctgctcccttcagcccggtgagaccctcccttgagggctgggattggaacgttacctggggtgaggggctggggccgagggagagtggagggtgccagctgctgcctgctgccgccgttggggcaacacttactctagtggggcagctgataaggagctttcatatcccccagcctcgagataaactttatctctgtccggagagtgataactgggggtgaggaggctgggcccctgccatgggaggggtgggcagccctggactcaccaacgtgtgaggtgcaggggttgggggcagtggggctggagggagatcatggtgggtaaggtggagttgaggggatgagggaatagtggtgaaagagtgagcagaagacacacaatgagacagggaagagagggagaaacagggagagatgggaagagagagacagagacacagagacaaagagcaagagacaaaagagacatgaagagaaaggaaaaacagagagagagaaactcaacgagtaagagacagagacagacagatggccggagaaaaagaaggaaagacccgggagcagaaaaggagatagaaatgcagagatacacgcaggtagcactgtgaagaggcagagactaacacagaattagagacagagaggaaagagatggagaccaagatggggaagcaaaacactctcttcagagagcaacagcaggcaccctggggctgagaaggtgttggcggtgggcacacttgtggcccatctctttcctagcataactcccaagcctgggcctgccccttagcctgtctataccatgggtcatgtaagcaggagtgaggggcagtttgaagacagccttctagtctagccctgtcactccaccctacagacacagaaacagagcaggccagcacaatagggccagggccagcattccaggctccttatcctgagctgcatgtggctgggtacggtcaggggtatgggactagtaagaggcacgtggacataaggtcagagggcccaaagagagggaaacagagggaacagacaaacaagcaggaagagtgggagagatgcagagatgttcagagagataggagaggagagggagaaagcaagagtaacagaaagagagagccagagagagaaacatgggaagacagaaaagaagacagaaaatcatcaaacattacaaaagcacagaaagaggtcgggcgcagtggctcacgcctataacctcagcactgtgggaggccgaggtgggccgatcacttgaggtcaggagttcaagaccagcctggccaacatggcaaaacctcgtctttactaaaaatacaaaaattagctgggtgtggtggcatgtgcctgtaatcccagctactagggaggctgaggcacgagaatcacttgaacctgggaggctggggttgcagtgagctgagatcgcaccactgcacaccagcctgggtgacagagtgagactccgtctcaaaaaaaaaaaaaaaagaaaaagaaaaagcacagaaggagaagacaagctatatcatagaaacacagaaagctggggaagctacagagtcagacttgagagggaacagagagtcaggggaaagagccccaggggatagagaagtggagagctagatgacagacacacacaaggcaaaacaggcaaagggccatcccacaggtctcagctcagccccagcccatcaccacccccaatacagcagatggggaaactgaggcctgggaactgaaagagcctgaaagcagaactctggtgggcctctccaggggagagggtaccggtagaggtacctcccacctgccaccctcttcagaggaagtcagtggccttggggtgatttcaaaagttgggcggggaaggcagagataagcagtggggggtactgacccccccccaaccaagaagtagggaggaactaagggggccttctgtctgtagacgcaacagaggtggagggaggagggagtcaagcccggaaaccatggggtttctgagaaagttagagggcaagatacaacagatagggatgaagttggggagcagaggatggtgaaccccaaagtcctgggtgaagtgaccaagaggcaagggactctggtcctgcatgccatcccaccctcacccagactcttctagagggggagggaagaaaggacggggggacggggagaataagaggaagtggaggaggggaggagaggagatggggaaagggagaaaaggatgaacagaaaagggaggagaaggatgaagaaattggaggggaggagaaaatgagtagtaggagaaaggagtggagagtagatgtagacaggggaagagaggccggaagtggtggctcacacctgtaatcccagtactttgggaggctgaggtgggaggatcacttgaggccaggagttcaagaccagcctgggcaacagagtcataccccatttctacaaaaaaaaaacaaaaactagccaggcctggtggcacacacctgtagtcccagctactcaggaggctgaggcaggaggatcactgccgggaggcagtggttgcagtgagccgagatcgtgccactgcactccagcctggcaacagaggagaccctgcctcaaaaaaaagtgtgtgtggatgggggagagggagataaggtgtgtgagaaaggtagaaaaggagaatgaagacaaaaagagaaggaggacaaggaagaggggaaacaggaaaggagaaggaggaggtcaaggaggaaaagaagaaggtggaggagaaaaaggaagcaggagagaatgagaaaagagtggaaagagaaggaaatggggaagaggggggcaaagaagagatgggaagaagagagacgggagaaagacaggaggaaaagggaaggggggaagaagagagagaatggaaggaagaagggagaggtagaagcagatgagagtggaggaagagcgagaggagggaggagaggaaagacaaacggcaagagggggagaacgaggaggaagatgaaaggaggggcacacaggagtggaacggggagatgcaggagggaaaagagaggagagggaggaagagaaggaggggaaggagaggggagactaaggtgaggaggaggggggaatggggaggtgggaaggagaaatatggagactgaggtgatggagtgggaggagggggaaaggaggaagaggagcaggtgaaaggatgtggggtggaaggatttctgtgtctgaggaccccttctgtcctcgcaggttaatccccagaggctccatggagttccctggcctggggtccctggggacctcagagcccctcccccagtttgtggatcctgctctggtgtcctccacaccagaatcaggggttttcttcccctctgggcctgagggcttggatgcagcagcttcctccactgccccgagcacagccaccgctgcagctgcggcactggcctactacagggacgctgaggcctacagacactccccaggtaactccattgagtggctgtcttggcattggctgagtgctgttggggttgccatggagatccttggctaggtcagaataccactgtgaggatatctcagaaatggctggaagcttctcaaatggatgtgccgaccactttccctagttaagtgcagacctgggaattccaatgctcctcaacctgccatattggggcggccacactgagaggcaatactggaagtatgtggtggttgccctagttgtcgagtgatccgtggagctccaaatcccaacagtcatcctcaaaaacccacttggaaatggtcagaggttattgcagaggccacactgaccagtgggggtcaggatccaggaagcatccaatggccagcagctgttctggtagcctgtggaaaagctgggaacttggccaccatgttgggggtgctgggaaccactgcaccctgacgtgcgctgaccctagactgattttgcctcttctttcctccatccctacctgcccccaacagtctttcaggtgtacccattgctcaactgtatggaggggatcccagggggctcaccatatgccggctgggcctacggcaagacggggctctaccctgcctcaactgtgtgtcccacccgcgaggactctcctccccaggccgtggaagatctggatggaaaaggcagcaccagcttcctggagactttgaagacagagcggctgagcccagacctcctgaccctgggacctgcactgccttcatcactccctgtccccaatagtgcttatgggggccctgacttttccagtaccttcttttctcccaccgggagccccctcaattcagcagcctattcctctcccaagcttcgtggaactctccccctgcctccctgtggtgagaaattcaaaaaaggacagggaagttgaggtgggaggggtggcccaaagtaaagctgagctgagcctagctccctcttctcctctccaccccaccagaggccagggagtgtgtgaactgcggagcaacagccactccactgtggcggagggacaggacaggccactacctatgcaacgcctgcggcctctatcacaagatgaatgggcagaacaggcccctcatccggcccaagaagcgcctggtaagaccacagacctgcttcaccttatacacaggaacccctgtcctcaccctgtacaagaagccacatcttcccattatataggaacgctgttctcatgattacaggaagctactgcaggccaccctgtatgggaacccctgtcccaatatcacatggaaacccttgccttcatcctacacaggaaaatctcctcatcccatatggaaatccttgccctcaccctgcatgagaactcctgccctttccttgtacaggaacccagatctatagaagctcctatcctcaacctacccttataagcttcaaacagaaacctttgtcctcaccctgcacaccagtgttttcgtccttggcttcacactggaatcaccccaggtcccttctcccagatgtgctgatggaattggactgggatgctgcttgggcatcaggatattttagctccccaagtgattccgatacgcagccaaagctgagaaccaccaatgtagtcccccatagaatacagaacaaaagaaacttataccagataggaacccctgtactggccccatacagaatcctcaggcatcaccctgtaaacaaagccctgccttcaacctgaccctcacttcttgggtcctcctgacatcccctgtgagccccttacccccacttccacatccccagggcactgatctcacatcctgtcgtcccctagattgtcagtaaacgggcaggtactcagtgcaccaactgccagacgaccaccacgacactgtggcggagaaatgccagtggggatcccgtgtgcaatgcctgcggcctctactacaagctacaccaggtgacgccctgccccttggagccacccctctgctttccctgtcttcatgccacactgccccccactctgttcctgttctacctctctcttcccccacaaccctctttcctctttcccctttccctccttcctcccccttcccccatctcttctactttcccccttcctccatctcttctactttcccccttctctgttattaccctccctccttccttctccattccctcctcctccgccctcctccttcctctcctctcccccacctccaggcatcagctaatgtccaaccccctgccctagaccttgggcagctcctatcagccttggaggctttcctaagctcagggcctcacagcctcaggattccttggacaatctcagcacccaaaaattatcttaccctgaaagaagtggggtagagagggtgtccctggttgacacagagaggcaaaggtctggagttggggacacccgcagcctcctttttggcaggtgaaccggccactgaccatgcggaaggatggtattcagactcgaaaccgcaaggcatctggaaaagggaaaaagaaacggggctccagtctgggaggcacaggagcagccgaaggaccagctggtggctttatggtggtggctgggggcagcggtagcgggaattgtggggaggtggcttcaggcctgacactgggccccccaggtactgcccatctctaccaaggcctgggccctgtggtgctgtcagggcctgttagccacctcatgcctttccctggacccctactgggctcacccacgggctccttccccacaggccccatgccccccaccaccagcactactgtggtggctccgctcagctcatgagggcacagagcatggcctccagaggaggggtggtgtccttctcctcttgtagccagaattctggacaacccaagtctctgggccccaggcaccccctggcttgaaccttcaaagcttttgtaaaataaaaccaccaaagtcctgaa

SEQ ID NO: 2294 - DNA, 11912 bp, Homo sapiens
aggattgtcgggaggaccctgggcaaagacgcctaccctgccatgctgcgccatctgccctccaggctgccagtcaagatgtggggcaggactttggagaaacaggtgaacaagatggcccctggggatctggggcaagggtgttggcactgaaactggtctagtaacctgtttcccttctctgcgggctcccatttcctgtcctcctctctccctttctctttcagagacaagcagagggcagcagaggcccatggaaaggcccggctctaagccatggagggccctgtgctcaggtgtgcagggctgggccggggctgagggctggctcctcccccagtttagccagggacaggtggagagatacaaaggtggctcacgcagggtgcccccaaagctgtcatgattaaggccatgtggagagaggctaggaaacacagcgctgaccttgagctttaggagaggaattcagaggcccctggcaacctgaaggggaccttgaagaggaccctgtaggaagacagaacacttccctgtagaggaggccaaaggaggaaggacatggtgttccgggcactctgactatagggattttatatgctgtggtgagaaataaaatggattatatttttgtagagtgtgtaaaacggggcttggcacacagtaagccttgtgtgattactatgtctttttttttttttttttttgagaccgaggtttgctcttgtcgcccagggtggagtgcagtggtgcaatctcaggtcactgcaacctctgcctcccaggttcaagcgattctcctgcctcagcctcccgagtaggggattacaggtgcacgtcaccatgcccagctaatttttgtatttttaatagagacaggatttcaccatgtaggccaggctggtctcaaactcctgacctcatgtaatccacccaccttggcctcccaaagtgctaggattacagacgtgagccactgcacccagtcctttgtgtgatgactatgtcttgatcatcattttataaagcaggctttgtaacttcacctccaagagtctgcaggatccagaccctgccttgccctcccacttatctctcactcactcttgggttctgagctacgctggccttcctgttattgaagacagccatccctgctcgtccttgaatttgcaaggatggagctccgagtctgcaaagcaggatctggggagtgaatctaagctggcagggaagaatagaataatgggaggaataggtggagtttatttctaacagactatcaaaatgatgcagatgtggccaaagcagtgcttagaggaaatctatagttctaaatgcacagatcagaaaagtagaaaagttgaaaatcaatgacctgagcttccctatcaagaaactgggaaaagaatggcaagtggaacctaagaaagtagaaggaaggaaattataacagcagaaactggtgaaatagaaagcaaagatacaataaagccaacaatgttaaaagttgattctttgaacagattaataaaatactagcaatgtctattttctctcgagaaattaagaaaatatatggattgccaatatcaggaatataaacagggtattgtgacagattctacagatgttagaaggttaataagggctgggtgcagtggctcatgcctgtaaccccaacactctgggaggctgaggagggaggattgcttgagcccaggaattcaagaccagcctgggaaacatagtgagccctcacctctacaaaaaaaaagaaaaaagaaaacaaaaaatagttgggcatggtggcacacacctgtaatcccagctactagggaggctgaagtaggaggattgcttgagtccaggaggttgaggctgcagtgagctgtgatcatgccaccatgctccaggctgggcaacaaagcaagaccctgtctcaaaaagggaattaaaaaagaaagttaataaaatttatttcaacatatgactttattttcaatggagccaaaatgtcggtcattttctctttctgcagttcctatgtccatgtggatcttttgtatccaccgggagagcaaaactcagcaactttgctaatgcctcctccactcaggaaaatagaatggtacaggattttttttagctggagctcagtgaaatcaattgtttaaaatgggctggtttcaatggaactaaacgcagtggaatagaaaataataaaatagcaaagggtagaacagaatagaatggaatccaatggaatcgaatcgaacagaatagaaactagtcagactttgtgccaagcactgtccctagttgttgcagtagatatttatttattgaacaaatatgattgaactagttgtttgggaaagagtggggaacaaaacagacagaagtccctgctcttatgaagcttacattctagtcagggagacaggcattaccatctgcaaaggcccataaatgaaaggtacaagggtggtccttatgaggaacaggctaaaggacagtgtagattggagttcaagagcaatggatgaggctgtagagatagggtgtcattgtaactggagtctagattttaacaagatgaccacacatcatcatcatcatcaatcgttttatagcacttgatatgtattaggcattgttctatgcccttaaaaacagtacttttttaaaactctcacaataatcctacatgtataaaatcatgctcattttatagaaggggaaaccaaggcacagataaattagataaattatttaaacgtcaatctggttccagaatcttcttttttttttttttttttagatacagtcttgctctgtcacccaggagtccggttgagtgatcatagctcattgcaacctccgcctcccaggctcaagtgatcctcccaccccaggcccccaagtaaccagaactacacgtgagcgccccacaacctaattttcatatttttttgtagatacagggtctcactgtgttgcctaggctgatctcaaactcctaggttcaagggatctgtctgcctcagccttccaaagtgctgagattacaggtgccaccactagaatctattcttttaagcattatactccattgcctatagtgccagaccacaggtgctttataatcctgtagcatagatactataaatattcaaattactaaataattcaagtcaagagaaagatctgatgggaagtgtgctgagggcgggaaagtggaaggttggggagtggtcctccctctgggtgtcaaggtggatctgtaaacacgcacgcccagaaaccttcatttcttctgagatgcccccttcttgtcttgttctctgtgactgaagctgcagaatgggaaaggagggggctgggtaaaattggccaattcacaggactgggcctcctctgtgtcttgtcacttcttggaaaagagatgaattctatttagggaaaaacaggggagggcattgtcttggtctccactcccctaatcttcacttctggaagaggagaaagggaacaagaaggctgggtgcagtggctcacccctgtaatcccagcactctgggaggccgaggtaggcagatcacttgaggtcaggagtttgagtttaagaccagcctgaccaacatagtgaaaccccgtctctactaaaaatacaaaaattagctgggcgtggtgacacacacctgtagtaccagctactcagggggctgaagcaggagaatcgcttgaagctgggaggcggaggttgcagtgaggtgagattgtgccactgcactccagcctgggcaacagagtgagactctgtctcaaaaaaaaaaaaaaaaaaaaaaaaaagaaaaggaaacaaggaaacagtggaaagtggtcatggtagacatgtgggctctcatgaatccacacatgggcagtaagactctaccagtaagtattctctcaggcctttccccttgaaggggggtgaggaggaagtagtgtaattggggaggtagggggaggtgaggagaagaaaacacaggcgttgacaagtggcaatgtggtctcttctgacttttttttctttttttagtcatggagggacagcagtcagacccctcccccatgtcttatccgtagacttgaccacatcgtgatgacggtgaagagcatcaaagacaccaccatgttttattccaagatcctgggcatggaggtcatgacttttaaggtaagcacttccccaaatgccaaaattcaggtgggctaaaatttgttgataacactttaacatataacttaactctaaaaggaaaaccacaggaaatctgagagaaaatataaagagatcaatagaggagattccaaactgaatatttggacttccagagagagaatggagaaaaaagagaggaggaaattatcatagaaacaatgcaagataactttgcagtctctacatggaaaaggttaaccaagtatccagcatgttgacacttaacatggatccttctaaaattatagaacatcaaactgaaaaagtagatcctaagagctttcatagagattaaaaagtagattatctacaaaggaaaaaaaaacaaatatcagattttccaagagaccagagaccaaaagataaaaggacaccttcaagattctgaggggaaaattttccacctagaattctatgtccaaccaaactattaaccaaaggtaaatgtaggggccaggtgcggtggctcatgcctgtaatcccagcactttgggaggccgaggtgggcggatcacttcaggtcaggagtttgagaccagcctggccaacatggcaaaaccccatctctactaaaagtacaaaaattagctgtgcatggtggtgcacgcctgtaatcccagctacttgggaggctgaggcatgagaattgcttgagcctgggaggcagaggttgcagtgagctgagattgcactacagcactctagtctgagtgacagagcaagactgtatcaaaaaaaatcaaacaaaaatgtaaatgtagaataaaagcattcttagtcatacgaagtcttacaaaatttcccacttgctttgaaaattacctgaggctatgctatatcaaaatgggggagtggccgggcacagtggctcacacctgtaatcccagcactttgggaggcagaggttgcagtgagccgagatcgcatcactgcactccagcctgggtgacagagcaagattccatctcaaaaaaaaaaaaaaaaaaaaaaaaaaaaaaaaccaacattggatgactatgaatctgggaatatggaagacatggaagtcaggccacaatggatcccaagaggaagatcccagaaaggtacttagagaaccatcagtccagtttggaacaggtgtaagaaagaccccaggaaagacagatccaaggggaaaaaaaagaggtttccagagattgaactacccttgagaatttggaataacttcaaaaaaggtaaatgcagagaaagcaaaaaatgccttactaagatgtgcttcagtaagtgaatggatgtatcaactgtggcacatccagacaatgaaatattattcagtgataaaaacaaatggattatctgccaggtgcagtggctcatgcctataatcccaacactttgggaggccgaggcgggtggatcacctgaggtcaggagtttgaggccagcctggccaacatggtgaaaccccgtctctactaaaagtacaaaaattagctgtgcatggtggtgcacgcctgtaatccctgattacgtggatcacctgaggtcaggagtttgaggccagcctataatcccacacaggcatggtggcgggcgcctgtaatcccagctactcgggaggctgaggcaggagaatcacatgaacccaggaggcggaggttgcagtgagccaagattgcaccattgcactccagcctgggcgacagagcaagactccatctcaaatagataaattaattaaataaaataaatggactatcaatccatgaaaagacatggaggaaacttaaatgcatattactaagtaaaagaagtgggggaggctgtgcatatgtgggggcaaggtgtatatatccctatacctcctgttcaattttgctgtggacctaaaaccgctctaaaacaattaagtacacatgaacacccctcccacacacacatataacttaaatagaaagggcttgaggaatcgcaaacaggagaagaaaaatttttttagacagtgtctcactctgttgcctaggctggagtatactggtgcgatcacagttcaccacagcctcaacctcccagactcaggtgcttctcttgcctcaccctcctgagtagttgagactgtaggcacgtgccaccacacctggccaattttttctatttggctaaaaatgttaaatctaacatggaaccttatgcagaaatgtagtattatgcaacatcagactggatgtgtacacagcaacacggacgggtcttgaaaagaacgtgctgagtgaaaaatgaagaaacaatcaggtctacagcatgctacccattacaatacacacacataaaacagtaacacactttttacagcaatttatgaaaaccaaaggatacacatcaaacgcactataatggttgcctaaggtggagatgggaatggataatgaacagaaaaagataaataaaacaagagatagtccttgcgtgggccaatggtgataacgaggtgtatgatgcctcaacctctgtacttggacacaatggagtgaaatttcagaacattaggattaagaaaaatcctaaagctgcagtagtggaagatggatgtatcaccaaccaaagaataaaacgcagatgaacatcagacttcttaacagcaacaccacatttggggaagacaatgaagcaacatatttaaaaggctatgggaaaataagctgcaacctacaactgcacactgagccaaactatcctcaagtccaaaagtgaaataaagttggccagacgtggtggctcacgcctgtaatcccaacactttgggaggctgagatgggtggatcacttgaggtcaggagttcgagaccagcctggacaacatgctgaaaccccatctctactaaaactacaaaaattagccaagcatggtggctcgcgcctgtagtcccagctactcgggaggctgaggcaggagaattgcttgaactcaggaggcggaggttgcagtgagctgagatctcgccactgcactccagcctgggtgacagagcgagactctgtctcaaaaaaaaaaaaaaagtgaaataaagtcattttctgattgaatggatgtggtatcattcatagtgatataaaagagatagaaaaagaaaaaaagaaatggcacatgttgagaggtccaggagagggaggattcatgaagaacatggcagggctgtgagttaatctgtagttgatctacaaaaataaacttgcagccaagcgtggtggctcacgcctgcaatcccaacactttgagaggatgaggcaggaggatcgcttgagctcaggagttggagtccagcctgggcaacatactgagactactgtctctacaaaaaaaaaaaaaaaagttttataattagccaggcgtggtggtgcgcacctataatggaatcccagctactcaggaggctgagacaggaggattgtttgaggccaggaggtcaaggctgcagtgagccgtgattgcaccactgcattccagcctgggtgatagaatgagactctgtctcttaaaaaaataaataaataaacaaaataaacatgcaaatgggttagttaaaaattgttaaggagctaaaagagaaactaaaaacgataatcaaattgtattggaagagatagtaatgtgaatgagctaaattttcatttgtcatagcagggagttgctaaatcaagaaatagtggtgcagccgggcacactggctcacatctgtaatcccagcactttgggaggccgaggcggggaacacttgagccaggagttcaagaccagcctgggcaacacggggagacccggtctctacaaaaaataaaaaaaaattagccaggcgtggtggggtgtgcctgtggtccctgctactcagaggctgaggttgcaggatcacttgagtctgggaggttgaggctgcagtgagccgtgatcactgcactgaaggctgggcgacagagcaagactctgtctcaaaaaaaaaaaaaaaagacgccaggcacagtgactcacacctgtaatctcagcactttgggaggctgaggtgggcagatcaccttaggtcaggagtttgagaccagcctggccaacatagcaaaaccccatctctactaaaaatataaaaattagctgggcatggtggcgtgtgcctgtagtcccagctactccagaggctgaggcacgagaatcacctgaaccagggatgtggaggttgcggtaagccaaaatggtgccactgcactccagcctgggcaacagagcaagactctgtctcaaataataataaataaataaataaataaacaaacaaacagtggtgcatcagttagggactttggaggcatgtaggagaaaactcaactaactgtgggttaaacaagacaagagttttcttttcgtttcactgaacaaccagtccagaggtagttagtcaggtcatgggcagtggctgggaagcaagaggaagtgaatgagcaataagggccagcgcagtagggttgggaggttcccagaagccccatccacacctctgcccccatctcattgcctggtccagctaacgtggcctccggacgtgctgggaaatgtaggtttttaaagttgggtacacggttgaccccactgaaatttctgttgtgtttataagaaataaaggggaaatgtatactgggtaggcaaattgctatctctgccttgagtggtataaacactatttggagatatggaaataatttcaaggagaaataaactcgtacacttgcctctagggaatgagccttgggtggggcaaagggctgttgtgtagtagccccattctagtttttattttttttaaaccttgttgggataggtggaaaggcttcatctcacactcatcttggaggtttaattctaggctgttttctctgcccctccccaccaagtaggaagaccggaaagcactgtgttttggagaccagaaatttaacctccacgaggtgggaaaggaatttgaacccaaagccgctcacccagttcctggctccctggacatatgtctgatcacagaggtgcctttggaggaaatgatccagcacctcaaggtgagtgggacttctcttctttttgcaaaagctgctgcaaacgcagtgaaaacagaagaatgacccagagaggtaacaagttttaccacaaccagataatgtctgcacacagttatgtactattttgactgacaattctttcatgtaaataaatgtgtttaaaaaggaaactgtgcattcccattgtaaaacaaacaaacaaacaaacaaacctacatttatgcactgaaatactttttttttttttttttgagacagagtcttgctctgttacccaggctgtagtatagtggcttgatctcggctcactgcaacctccacctcctgggttcaagcgattctcctgcctcagcctcccaagttgctggtactacaggtgcgtgccaccacacctggctaatttttgtagttttagtagagacagggtttcaccacgttggccaggctggtctcaaactcctgacctcaagtgctccgcccacctcggcctcccaaagtgctggccattacaggcatgagccacgtgcccagccctaaatacatttatataaaaagaaaacgttcatccaagtacatgaaaaacccattatatcttggcataaaggaaaagtaactgtaaaaaccaacagctatgaaagcataacaatgtcattagattctagccacttccgttccctgtactccctggccctgacattacaaagggagatatggcaggtggttaaagagatactaagaacttgttagcatccaccttctatgtgtaaaaagaaggactgaaagaagattggagagggaataatttctgatttgttgttatttaatccagtgtctctgtaatacttaaaatgatgtcatctagaagaggcattggttgggcacggtcactcacgcctgtaatcccagcactttgggaggctgaggtggcaggatcatttgggccaggagttccagaccagcctgggcaacatagtgagatcccatctcttaaaaaaaataaacagagtagccaggcatggtagtgcatgcccgtaatcctagctattcaagagggtgaagtgggaggatcacttgagcccaggaggtggaggctacagtgagctatgatcacgccactgcactccagcctgggtgatacagcaagaccctgtctctaaaaaattaaaataaggctggggcacagtggctcatgcctgtaatcccagtgctttaggaggccaaggagggaggatcacttgaacccaggaatttgagaccagcctgggtaacatggcgagaccctgtgtctacataaaatacaaaaaaaaattagccagacgtggcggtgtgtgcctgtagtctcagctacttgggaggctaagaggtgggaggatcgtttgagcccaggttgaggctgtagtgagctgtgatcgcaccactccattctagtcagtgtgacagagcaaggccccatctctacaataaataaataaaaggggttttagtttcccttttgcagaacacggattgaggtcttatatatattctgtgcaaataacctagactccttctttgggaagtgtcagtgaaaaagactggtttggaagtaaaatgggtgaagcataggggttaagagtatggtcgttgacccagactgcctaggttcgaattctggttctgccatttactagataatactaggtactattatccttcccattttacagatgaggagatcgaggtacagggtagttaggtactgtgcccaaggccatctagctgataagtggctggaacggagtgatggaggggaggatggtaggagatgaggtcagaaagatacagcggtgttctaaggtcttctaggccactataaggaattaaattttacaggccaggcgcagtggttcatgcctataattccagcactttaggaggctgaggcgggcggatcacttgaggtcaggagttcgagaccagcctgggcagcacagcaagacctcgtctctatgaaaaatagctgggcatggtggcatgcgcctgtaatcccagctactcaggaggctgaggtgggagaattgcttgagcctaggaggcagcggaggttgcagtgagctgagatctcaccactgcactccagcctgggtgacggagcgagactctgtcacaaaaaaaaaaaaaaggcattaaattttggtctcacacacacattttgacgaacgacttttgtcttttcttcccacttcaggcttgtgatgtccctattgaggaggggccagtccccagaacaggggcaaaagggcctatcatgtccatctacttccgagaccccgacagaaatctgattgaggtgtccaactacatctcctcgtgatggaggctggacctcctccattctgtcccccttgatgtcgccctctcctttccttcctgcaaacccccacccaggcccagagatctccaaagactgaggacttaggcacttcacacatcctgctgaggggggacccaagacaggtttgggaccaaacctacatgtctgtatgtcatcaaagttggcctaataaatgcataacctctcaatgaa

SEQ ID NO: 2295 - DNA, 4456 bp, Homo sapiens
ctgcttcagatcatgtttattgtggggccagggggtagggatcctcgggtgagagggctggctggccggggtaagttgctctggacgtgctggcggggagcagtcctggtggcgggatggcgggggcacttctgggtcccagggtgcacgggatccgggcagtgctcagggtggcaagaggcggcgtgcaggcacctggggcgccggggtctctaggcgtttcacacgcagcagcgcccccagcacgccctcagggggcagctcagagcccacatcgtggtcggcggcacggcggaggcggcgcggggctgccaccccctcggagtccgcgcttcccgcaagaatccgtcccagcaagtacctgcagggccgagcgcaaagcagtgaggcggtgtccgcggtggggcgttcccccgccccacgctcggggcccagaacgcaggatccacaaccacatactgcctggggacacggttccctccccaagaaggcgtcctcagcccactgctttcagtagacagccgtcatcgcctttcatcccagaaaactgtggcttccccgcctccctctccccttcccaggacctggggtccacttcccccactgagtcagccaggcatccttgcctggactccctggatccaggacctcactccctcttaggccccaggacttaggggttcgcactccacggggtaagcaggcttcccagttcctcgccctcgtcctctccggacgcaggcgcccgacccctccccaccccctgccgggcacctcaacagctcggggtccacgtcgggtgtctcgtcgcctgcctcctcagcatccgggcccgcggggccgtcgtcgtagaccgggggccggggtcggagcgccgcggcggggacgggcgcggggacaagctgggctgcgagggcggcagggtcaaggcgggcgcggagcagagcgcgagcgagctgcgctgcaggcgcgtcggggtcgtcgtccaggcccagagccggatcagagttgcggggggcgccccagacgcgcagcagctgcgccaggacgcgcgcctgctgatcctcagcctcctgcgcctcggcccgcgcccgctcctgacgttcggcctccagcagatgcgccagcgcccgcgccagctcctgcaccgcccccgccgcctcacctcggggcactgaccgccggaagcggcgaggagcgccagtctcagccaagggcggagacgctgcgcttaggccgcggggctcctgcgggaaaatgaggtgggggaaaagagtttgtcagcgtccgtcgagacagggacccccagcccgggaagcttcgtaggcctcaaacatcccagatgccaccaaaagcaccgtgaccatccaaatatacccggacacccctaaggccactggaaaccaccaaatatctccagacgcacttaagaccaccaaagatccccagacaccccccacccccaccccacagcgcgccagtgatcccttggtgactctcataattcctccctccccacccccactcctggagaccgagtttcttcataagagtagtgatggtagatatgacagttatagatttttccatatttaatattgtggacaataggaactatatgaataaacttgttcatatatcatttggcatgtgtacaagttcatctgtagaataaattacccaatgacaaattttcagttcaagcagttttcaaacaatttccacaagtttaaagaaataaaagagggtaccaataatctgagcaaggaataaaagatcataaaaatgactgtgaaggtttggaaaagaaacatacaggccacatataaatatgtttaaaaggagtgatgcctgcaacacaaatagtcaatgaaagagtagtacacagaagatacagagaattcctaaaaagtagtaagagaaaaacaaactcatacagaaatagaaaaaatacatgatcgcctatttcacaaaaatgattactaaacatatgaaaaattgggccaggtgtagtggttcatgcctgtaatcccagcactttgggaggccaaggcaggaagatcgcttgaggccaggagtttgagaccagcctggtcaaaatggcgagaccctgtctctacaaaaaataaaaccaaaaaaaatgagcggggcacaagcccatagtcccagctacttgggaagatgaggtgggaggatcacctgagtccagaagctcaaggttgcagtgagcccagatcgcaccactgcactccagcgtgcatgacagaggaagaccctgtctctaacaaacataaaataaaattaaaaacctcattagtaatcaggggaaagcaaattaaaatgccagggagatactatgcataatataaccaaaagattgacccaaatcaaaaagtctgataatatgaagtgttgatatgaatgcagaaaaatgggaactctcatactatgctggtgagaattaaactggcaaagtaattttgcagagcggtttgacaatatctaaaaagatgcacatatcctatgacccactcctgggatgtcactccccagagcagctttggcacatacgctactggtcacaagttcgtgaaagatgacagcagcactgttcgtaatagcataaaagggcgggggagaaagaaaagcctggaaacagtccaatgtccactgacaaattgagaatacatatataaatcatgatgtcctcataggatgtaatattatgcagcaataaaaataaatgaattacagccacatgcatcaacttggatgaatctcgtgaccagaatagagccaagggaaaaaaaaacgtcaagttccagaatttcactgcagactgcctgagactactagacaccctgaggacttcctagtgacccctagtgactacgaggaaccagtcacccagtatgattccgtttcaatgatgttcaaaagcaggaaaaactaaacaatggattttttttgagagctacacatatgtgataagctacaaacaaaagtaagggatcaatggacagaaaatacagaataaggactgtggggggacaggggctgccatggcgaggggcacgcaggggcttctaactcttggtcaggctctatttattaagctgagtgactgctacacgagagagttattttgtcatcattctttacattgtacatatatattaaacacattgttacacggatataaggtaacagttttttttaattcccatctttgatgcagacagtattgaagagctagaggaggatgcctctccaagtgcccttgctggcgcccaccactcctcagtcaccccggggtatcacactcaccagcaatcacagcctcacacacactcatgaggactgacaggcctggagatgtcacatatacagcccaacactgccacagccacatgcaaggacctgcacacgttcacatccgcagctgctcctgcagttacaatcgccaagccacccaggtgcaaggacatgcaccatccttaaagacacaatgcagcagagagacatcatggctcctctcctcaggatgacacagctccacaaagaaacggagagaaacagtctcaggaacacgcaaacgaaatcccaggcacttggtccaacagaaccactatggaatgtgcacacggagatgcgaagaccattccctctcaaacacaaacgaaatcacacacacacacacacacacacacacacacagagagagagagagacagagagagagagagagagacacgcccataggccaagccaacacacataataaggattcacaaatatccacacggtgtcactgagaaaacaatcggacgcacaaaagaatcgcgcacagaagtatcccggtatcacacacactacacacccagacgcaccacggcacctttctaggacacttggaagcgctcaaaccaaagaacacacactttcaaggacacgacacctccacaccgctctcctcacatcacacgcacacacactgatgcgcgcgcgccctttcttaaagcgccttagtgccgtggacagcgtcacaggcaccgggcacggagaggtgggcagggcacggttaccggcggcgccccggacaacgccacccgcacaggcagagaccaagtcaggtctcaggtgtgccggcgtggcctgggcgcggaccggcggccggagcccgggccaccctcgtcgatctctccgcacgtcccgggagccggctcgggcgggggtgaggcggcgcagccccaaccccaaccctcgccggtggcatcctcccccaacccccacccctcgccggactggggtcgcacctttaccggccgcgcgcagagcgcggggggcggccgaaacaggccgagcagcagcagcaccaaaaggccgacgcccccggcccgcggcccccagagcagcggcgaccccgccatgctgccccagcgagccgggctccgga

SEQ ID NO: 2296 - DNA, 22895 bp, Homo sapiens
ggggcagtcccctgaggagcggggctggttgaaacgctaggggcgggatctggcggagtggaaggtaccggtccggcccgataaggggtggagttaagtgaatcgttaagggtggagtcgaaaccggggtcggggccggggccggctgagtgaaagggtgggtgattatcccgggagataggccgaaagggcaggttcgtgaaggaatggggtctgggctgggcttagagggtctgggaatggggcttaggagagtagaaggggcggtgattggttggaaagggcaggccctaagacggactgtgtgagcccgggggctcattgctccgtgaaagggcaagaccagggaaagagaatcgtgtaaaaggggtggagtctagcgggccgggcggggccgggtagaatggccacctgagtggagggagaaggcctgagagaggcggagtttggaaggctgtggagaatcagatcgcgtaaggaatggaatctaatagagggggcggagcctggaaaagggcagagaggtggggtcctcagggcacactagccccctcacatacccacgctcctccccccacccccagaaccgcggcaggggccaagcctcctcaactatgacctcaaccggccaggattccaccacaaccaggcagcgaagaagtaggcagaacccccagtcgccccctcaggactccagtgtcacttcggtgaggccctagacccgccctgatgagggggagagggagcaagttggtcatgccctggactctgacccttctctctgattcacagaagcgaaatattaaaaagggagccgttccccgctctatccccaatctagcggaggtaaagaagaaaggcaaaatgaagaagctcggccaagcaatggaagaagacctaatcgtgggactgcaagggatggtgagcagggcctggctgcagtttagcctcgtatgacaatcaaaacccaaaggttccccaccctggacagttccctctgactcagggcctaaaatggatctgtgtctccttttttttttcctctgcaggatctgaaccttgaggctgaagcactggctggcactggcttggtgttggatgagcagttaaatgaattccattgcctctgggatgacaggtgaggctgggtcctccaggctgtctccaaaccacaaaaatacacacacttagagcccattagcaagaataaatcttttcttaccccagcctggatactggaagcagatgatttggggaggtagggctcacacttgaaagggttcttttatgtagctaacaaacatttattgagtgcctattgtgtgccaagagttggtgatacaaatgtaccaaacaacagacaggggtccttctctaggagcggattgatgagtaggagggcagatcattaaacagccaacagcagtatgaggtgtttaatgaagacagacttaagaccaggggattcaagggtgtataatagaggatcctaaactagtatccgggcttcccagaagcctttatagaggaagagacgtttgtactgaaacagaaggatgaaacctcccgtttgctttacttttcaaaaagaatcagcaaatccttttggctatatgttcaaaatatattcaccatctgacctctcctcaccacctccactgccaccatcatcatcactcacctagacttgcagaggcctcctccctggtcccctacttccaacctcacctctattatctgttcatgcagcaacctaaaaaaatatgtatgagttgatgtctttgttaaaatactttaaggaggccaggcatggtggctcacgcctataatcccagcactttgggggggccaaggcaggtggatcacttgaggtcaggagttcgagaccggtctgaccaacgcgatgaaacactgtctctactaaaaatacaaaaattagttgggcgtggtggcacacacctgtaatcctagctacttgggaggctgaggcaggagaatcgcttgatctgggaggcggaggttgcagtgagccgagattgtgccattgcaccccagcctgggcaacaagagcaaaactctgtctcaaaaagtaaaaataaaaaaaaaaaaagtactttaagggcaaactgttgccctcaaggtaaagtccaaatttttcatcctggcctcaaaggttccacatgatctggctccacatcactttgtgacctcatcagccaatccttctcgcccacactactccccttgttcttccaacatgccaggcaccctcttgcctctggtctgtaccctgaccaacccctttcccagagattcttttcggtcttctactcttccagctgcctttcacatcccaatgagactttctcagagaaggttttgcctggccaaaccctaccccaatacctgatcttattttcctagcccatgacattgtttgctaattatcatacttgtgtgtttaccaattaatatctatatcccttatcccaacctaagactaacttactatgggaaaaagacttcttttatggaatacctatttaccatctattgaggagctagggatacagcagtaaacaaaacaaacaaaagcctgtgtcttcagggtaaagggggaagacagacaataaataaacaaaaagtaaatgatgcactgtggtagaaagagcagtgttatgaagaagcagtaaagggaggatagtaggagaaagtacagtggaggagacttcaattttaaataggctggtcagggaaggcctcactatttgagcagggatctgaagaggtgaaggagtaagtcatggagacagttggaggaagagtattctaggcgggggtgggggggccagctagagtaaagttctagggctggctgaagagtatttggttcaactgagaaccagggaagagaccagtgtaggtgaagcgaagcaaaggaaagagggaggggtaggagatggggtcagagaggtgatggaggacagattgtttagggccttctgggcatgggtaatactttggcttttactcagaatgggatgggagcctcgaagggacatgaactgattagggttttaaccagtgtctagctgctatgcacagaaaggaccgttgaggtggcgagggtcgaagcagggaggccgaggagatgccgccacagcccaggcgggagggtatggtaatagcagtggcagtggtgaggagagggtcacacaccagagctgatgggaggcaggactgacaccacagttttggggtaagcagctgtggaagggtggatggggagatgtggagagaacagatgtggagctccccagtgtcctcatgcatctgtgactgtgactccatctccccagcttcccggaaggccctgagcggctccatgccatcaaggagcaactgatccaggagggcctcctagatcgctgcgtgtcctttcaggtaaggcccccaagccaacactctgggtgaagggcagggagctgacctgacctgggtgcagcccatgccttaaccctttaccccactttattcctcatctctccccaggcccggtttgctgaaaaggaagagctgatgttggttcacaggtgaaggcttgggagccttgtagggatggggaggagcctgccctggacaaaccagggcaagctaaacgctttgggaagcaatgtcatggtctctgcagccagccttgggcaagtcgctgagcctttctgaatctgtgtcatcgcctgtaacaaggggaccagtaaacataagttcctcaggagagtttgatgtgtgtcaggtgcttagaacagggcctgatatataatcagcccatgatgagctattactgttatcatgatctgattgtgtgaatagatggtggatgtgtggacagagtgatcggggttcccccaggggcttccagatttagaggcctagtgctatgtggcttgaggaaagctagcttccagagcaggtatctgagctgaactttaagaggagaaaaagagtgagtcagatgaagagggtgactgagggaagggaagaacagacagctgaaccagtgtggccaaaggcctgaaagtaggatttggtgtggctactgcaggggagcagagaacattacctgaactgaggcgggctagggaagaaacagaatgtgtcttatatcctggctattccttcaggttgacagttgggggagccaagccctaatttgaccagggggttggtgtatggacagctcagttggggaagagacagggccctgaatctcatctcccatctgtgtctagcctagaatatattgatctgatggaaacaacccagtacatgaatgagggagaactccgtgtcctagcagacacctacgactcagtttatctgcatccggtatggatgagaactctgcgggcagggaatggtggcaatcttggggtccccatccctatgcccaccccaccctgggggaagcagctgagtggatagggctgttctctcccttactccctttctggctccccactgtctctccagaactcatactcctgtgcctgcctggcctcaggctctgtcctcaggctggtggatgcggtcctgggggctgagatccggaatggcatggccatcattaggtaggactctacagcatttgactttttacattgttttaaagtccttccttcaagtgtaaaatgtattgatatgggtaatatattcatgtgattcaagaatccaaaggtaaaaaagagaatataattaaaaatctgtctcccatccttgtcacccagacacctgcctcctctcatgggaggtagtcattggaaccactgactcatgtgtcctcccacaaagtcttattcaagaaataaataccatatttcattgattctaaggtgtacattttttcatatttgtaacatcttgaaatccagatgcatcttacaaacagtgacatctcagaattccattggcagtattttctgcttcgtttttggcatgtaaaatcatggtacatcttatcatcattggcatcccagaactgatgaaatgcaaaagctttctcctccctcccctgtttttaaccacaaatggtagtaacatgacatactcccttcgtaccatcttttcacttacacatcttggaaacctttctctaacagtatgtatcttggagcccggtagaacaccattgtgtaaatgcactctatgttaatcagtccccgactaatgggcattttggttctccccagtcatttgctgttttaaaaaaatgctacagcaaatatgctagtacctttataaaaataaaattttattttacactaacataaaataaaaatgttacttcaccctttttaaaacacaggttgtgggctaagttcctgcagcagaatgactgggtatgagaatgaatgcgttgatcattttatttttatttttatttatttatttattttgagacggagtctcgctctgtcaccaggctggagtgcagtgatgcaatcttggctcactgcaacctctgcctcccaggttcaagtgattctcctgcctcagcctcccaagtagctgggactacagtcgcccgccaccacacccagctaattttttgtatttttagtagagacggggtttcaccgtgttggccaggatggtcttgatctcttgacctcgtggtccacccacctcggcctcccaaagtgctgggattacaggcctgagccaccgcacccggcctttatcattttagtgaacattttcaaatctcctttggagacagaggggtagattggcagggggtgagagtttgagggcctccattactcagttcccggcagatttttaggcatcagcattaaaggaattggtggtccaggattagagagcaggggacagtctgtctctgcagaggaggacccctcacatactccaagctgttatttccttgtcttgcccaggcctcctggacatcacgcccagcacagtcttatggatggctattgcatgttcaaccacgtggctgtggcagcccgctatgctcaacagaaacaccgcatccggaggtcagcaacagagggcagatgtgatgggggtggcatggggtggggtgtcctggtctgggctcttcccccagattcaccttgatctccttgcacagagtcccctctctctgctgctcctagggtccttatcgtagattgggatgtgcaccacggtcaaggaacacagttcaccttcgaccaggaccccaggtataccccgactcccacctaggtgctagactcccagccacctcccacccttacaggcccagccagaaggggtccagaaggaggaaaaggcattcacattcatggggcctatcctgggatcaggatctgtgctacttttgtgtgtctgccatctctcctaatttcactctgaggcagggactgttgggttccctattttacagatagggggactgaggcttatacgttaagaggtcacacagagaagaactgggagagacgggatttgacccacaaatatttgaagatcttattcactgattaaccgttgggttagagtgaacctcaaattactgctttattttttctgattaggataatgcttcaaagtgtttgtttatcctttcagtagatagtaaaaaacaaatataaataaataaataacaaactatttgtttaaagaaattaaataatacagaagtgtctgaagcagtgagtctcctctaatttccattacctcaaaaataagtgttgacagtttaggttatatccttacagattttctctatagatgtctgaatttttattattattgttataattattaataacacactgcctaatggaataattctccacatgttcttcgacaacttgctttattcatttaacagcatatctgggacatttctccatgttagtacctcttaaagtatctcgttctttgtagtattcaattttatgactgtacctctggttatttaaccccaggacttttaagatgcctgccagtttttgctattacaggcacttctactgtgaatagtctagtaaatatgtaattctgcacttctctgagtctatctgtaggatgaatttctaacagtgggttgcttgggccagagagtcagcatactttaaagtctggtatacactgccagacttccctccaggaggggaccagcttacccttcctgcagaaagtgattgagcaagtccttgtcagtaggagacattactaagtacatgtcgagtatcccttatatgaagtgcttggaaccagaagtatttcacatttcagattttttcagattttgaaatatttatattatacttagtggttgagcatccttaatctgaaaacccaaaatccgaaataccccaatgagcatttcctttgagcatcatgttggccttcaaaaagtttaggattttagggccgggtgaagtagctcactcctgtaatcccagtactttgggaggccgaggcggatcacctgaggtcaggagttcaagatcagcttggccaacatggtgaaaccccgtctctacaaaaatacagaaaaattagccaggcgtggtggcacacacctgtatttccagctactcaggaggctgaggcaggagaatcacttgaacccaggaggcagaggttgcagtgagctgagatcgcaccactgcactccagcctgggtgatagactgagaccccatctaaaaaaaaaaaaaaagtttaggattttacagcatttcagatttcagatttctagattagggatgctcaacctgtagtagttttatctagccttcttcctagctgactacagagaatccacttatccaagatctgaagaatccaatttaggttggttgttctctagacattgctttattattttgcagcattcagtgttcctgacaggtgtctgcttttcattcctttccaagtaatctactttcctctctgcaaggttatcttggtgttcttttttttttttttttaaattattagacagggtatcactgtgtcacccaggctggagtatagtagcatgatcatagcccactgtaacctcaaactcctgggctcaagcaatcctcctgcctcagcctcccaagtagctaggactgcaggcatgtgccaccacacccagctaattttttaaattatttgtagagacagggtctcactatattgcccagactggtctcgaactcctgacctcaagtgtcctcccactgcagcctctcaaagcactgagattacaggcatgagccactgtacctagccttgatgttctaaacttttaccctggccttttcactctgtttaatagtaggtagacattttacatctgaagattcatgcttttcttaaactcttggaaattattttctattagatctttgataatttcttctttgttttctctgttctctttctaggacttctgttagtcagatgttagacttcctgggttgatcctctatgtctctctcttttttattatttatttatttatttatttatttattttttttgagacaaggtcttgctctgttgcccagactggagtacagtggcacaaatacgactcactgcagcctcgacctcccgggctcaagcaatcctcatgcctcagcctcctgagtagctgggaccacaggtgcacaccagcatacccagctaattttttaatcttttgtagagatggggtctcaccatgttgcccaggcttcttattttttatcttatgttttctgtctcttttttcttttgctgtgacctgggagattttgtcaactttatcttcaagcccttctgttgaattatgtatttagatatcctgttaaactccaaaagctctttcttcctctctgtttctatgtcctctcatacctgatcttgtttttatagagtatggattagaagtgccggctgggtgcggtggctcatgcctgtaatcccagcactttgggaggccgaggtgagtggatcacttgaggccaggagttcgagaccagtctggccaacatggtgaaaccccatctctactaaaaatacaaaaattacccagacgtgatggtgcgcacctgtaatcccagctactcaggaggctgaggcaggagaatcgcttgaacccaggaggcggaggttgcagtgagacaagatcatgccactgcactccagcctgggcgatagagggagaccctgtctcaaaaaaggaagtgccttaagtttcttctgttgtctgagttatgtctctttattctgaggctggttgaattatttttttcttggtccttctcttttatgctgatggttttcctcaaatgtctagcaatccttatttggctatttatacccaagaatgaaggcccattgtagggggctgtcagaggactactctgctgcagtgtttgtaggtctgttttcctgaaaggcatttccccagaatggggacagggaatgtccactgacaggttgcaactttagcgagtgtgggcaaggacccgggcattagatgggatcctgccagatgtcagaacaaaggaggcctcttctttggggtaacatctcttttttccctcagcctttccaaagtgtatctgttgtacttatcttttccagtgtagctttgggctttgttggtcatctctactgttttattatggtgggtttttaatacttcattaatttttctggttttatctttattaatgttttcctccgacgttctttattttgttcatttctggcttctggaatttaatgcttcaacatttatcaactcattggccgatctcatttcatctatacctgtacccactgccctcttcctgttttccttcaaagctaatcccagataccatataatttctcctgtaaatatttcagaatgcatctctaaaacataagtacacttttttagaaaagcattaccttagtatcaatacctgaaaattaacaataattatttttttaatctgccaagggtctgtcattcaaagaattctttaatatcattaatcattctttttgtttgaataaatgcataggaggctatagctgtgtgttctttcatgggtacactattgattacacacacagatgtgaaacactgtgaatatattcagtgcattcttccttattaacaaacgtgtgtaaacaaacaaacaaaaagaacatgtccatgcccttggatctcccagctccccatctctcagtctctgaactccagcagcagggagacaaactggataatccttaaaatactgttgtgaagacaaggaaagcagatgatctaaaactaagtagttaaaagaaacaagtaactttgttgtattggtgattcagtgagttggctcttcagaagggattttgtgtgcattgacctggatctgtactggatttctccagaaaggaaacttcagcttatcttgggtgcccccttatcctgctcagcatgagacagagcaccctggggcccctggaatctcaaagtctactttctagaaattcattgaagtctcttattctctgacatcctttccactctctctttctgggttgctgtttgtttacaatttctttactgtattttgaatggggtagtaggaggttgaggaagtaaacctgtgctatcaatccaccatttaacttgaaggtggttgaacttattttgaatttcccttctgttttctttttaaacttagcttgagtgctagttctgctgtttattgactttgatggctctcttttagagtcagctttcttcagatcttttctttcttcctgtcttccccaatgatatttttttcttttcctttctttttttttgagacagagtcatgctctgtcgcccaggctggagtgcagtggcccgatctcggctcactgcaacctccgcctcctgggttcaagcaattctcctacctccacctcccaagtagctaggattacaggcacgcgccaccacgcccagcaaattttttgtatttttagtagagacagggtttcgccatgttggccatgctggtctcgaacttctggcctctagtgatccgcccaccttggcctcccaaagtgctgggattacaggtgtgaaccactgcgcccagccctctggtgataatttttatgtcctactgtgtttctcttcctctaatgattaacttactaaaagtttagaaccaagatttatctatcaatgtcaaaaataaaacaatcatcctccacctactcaacaccagagcttttgcttgtttttattccccaattccaagctcttttccctcaattttaagaatctttctatatcacttgcattaaatttcacaactacattatcaacccattaaaatgtgactcttaagtttgtctagattcaatgcataccactatttcttgcatttccctaaaaaagctgccttagatcctctctggaacaaagcagggggtaaatgaccagatagaaggatggatggatgatagattattcattttgctttccccagtcagaattaagccctcccatggccccttgctgggctttctgtcaaaacacgtgcatcgcatcttttcagtatctgttttgcgtgtcggtcatactcacccctctgagtgctcattctctcgcctataaaatagaagaagtagtagaggtggcctgtaaggcattggggaggaggaactgccctttcactggcctcatgacagccccagccagcacccccgctctagttccacccacagaagcaagtctcacccctaccccccaggtctctccacttcctgctagagaatcacccagctccccagcctggcttgaggctcttttcagccttagctggctccccgcagctaagagccccatgctccatttgggcctccagtgtcacagggtttgacctgctgttactactacctttgtcataggggcaggtagtgggcggacatgatctagagtaccccacagagtcaggagcccccatgatctgagatagaccctagagctgagcctgaaattgggtgggcactgagggggcagcgatgtttgctgagggagaggttctggtgagagactaaatgaatgagcgagtgaggtaatggataaataaagataagaatgaaaaaatggtaagatgattaaattggtgactgaatgtaagggtaaattaatggaagaatggattcatggattaaataattaatggggaaattaatgaatgagagaatgaacgagtggttgaatggggaaatgagtggtagaggaaactggcaactgttgggttgggggtgtctatggggattgacttctccaactctcttacctctttttcttctgcccccagtgtcctctatttctccatccaccgctacgagcagggtaggttctggccccacctgaaggcctctaactggtccaccacaggtttcggccaaggccaaggatataccatcaatgtgccttggaaccaggtcagcatctacccacctctgcccccaaagtgaggcccagccccgcccttctgtcagcggctcgggacaggtggctgaacatcccccatcacactcctgtgtctgcaggtggggatgcgggatgctgactacattgctgctttcctgcacgtcctgctgccagtcgccctcgaggtcctggggatctggggtgtgttgggaggaggagtggccttgaaggttaggctgtgagggtaggtagcctcatggagtctgttcccccttcagttccagcctcagctggtcctggtggctgctggatttgatgccctgcaaggggaccccaaggtaaggcaggctccctggggcggcaggtgggttgcatggagccaggctgaccctccatgtccccccagggtgagatggccgccactccggcagggttcgcccagctaacccacctgctcatgggtctggcaggaggcaagctgatcctgtctctggaggtgagtgactcaccttcgtccctcagcctgtggatcctggagggcttaagaacgaagctttcaagtccaacaggagttcctggcccaggaattcacttactagctggacaaccttgcataagtcacttcacttctttgtgcctccgctttccttctataaaacgagcataatgtaatcacctcatatcattgtccagtgaattcagtgaggcacccttctaagttccttgttgcttgacatgtggtatgcactctcttattatcatcattattattattccctggtcatgtctggtcctttcctgatcccccttcacaactccttgccccagggtggctacaacctccgcgccctggctgaaggcgtcagtgcttcgctccacacccttctgggagacccttgccccatgctggagtcacctggtgccccctgccggaggtgagccccggtggaggaggggaaagcgggagcctcactgcccgcccacattccttgacatcatattttctccctgccctgcagtgcccaggcttcagtttcctgtgctctggaagcccttgagcccttctgggaggttcttgtgagatcaagtaggaagtggggtgtgggcctggtgtggggtggacgtgggatgagccctgggggagactgtcttcagacttcctctgactttactgggctgccttggtgggagagggtcaggccctctctctctccctgggccctggtttcaggcctcccacccctttttctgtttgggtcacctgagttccagagtatgacggggattcagattgagagggtaggacaaacgtggcctcccccttttagctgagaccgtggagagggacaacatggaggaggacaatgtagaggagagcgaggaggaaggaccctgggagccccctgtgctcccaatcctgacatggccagtgctacagtctcgcacagggctggtctatgaccaaaatatgatgaatcactgcaacttgtgggacaggtaggcatttggagggctggatgagtaggtgttgggggtccctccccctcaggcactaagcctctacctctcgtttccccactgctagccaccaccctgaggtaccccagcgcatcttgcggatcatgtgccgtctggaggagctgggccttgccgggcgctgcctcaccctgacaccgcgccctgccacagaggctgagctgctcacctgtcacaggtcagaccccggtgcctggggtgggtggattcccaggactgtggatgaggtctcaggggctggaacttgggtttcccctcctggggagctgctgcaggacttgagaggggctgaagtccctgtcttaggggtggggaccagggaggggacagaccctcctcactgtcctgcgggtgctcctctctgtgcttccagtgctgagtacgtgggtcatctccgggccacagagaaaatgaaaacccgggagctgcaccgtgagagttccaactttgactccatctatatctgccccagtaccttcgcctgtgcacagcttgccactggcgctgcctgccgcctggtggaggctgtgctctcaggagaggtgtgtcctctgtgggctggggagaggaggacctggggggaatggaaaaagagagccatctgctgtttctggaggctctgagagagtcaagcagggcctgaggaaaggggccatggggaggggcacgggagggggtgggcctagaggctgggggaataatggaaggaactggagaaagggaagggtggccaagtgcagtggctcacgtctgtaatcctagcgctttgagaagctgaggtgagctcaggaggtcaaggctgcagtaagccatgattgcaccactgcactctagcctgggcaacagagtgagaccctgtgtcaaaaaaaaaaaaaggtccgggcgtgatggctcacacctgtaatcccagcactttgggaggccgaggtgggcagatcacgaggtcaggagatcgagaccatcctggataacatggtgaaaccccgtctctactaaaaaacatacaaaaaattagccgggcgtggcagcaagcgcctgtagtcctagctactcaggaggctgaggcaggagaatggcgggaacctggcaggcggcgcttgcagtgagccgagatggcgccactgcattccagcctgggcgacagagcgagactccgtctcaaaaaaaaaaaaaaaaaaggaagaaaggaaggtgagggcaggctgtccgatcttagcaccctgctgcttcccaggttctgaatggtgctgctgtggtgcgtcccccaggacaccacgcagagcaggatgcagcttgcggtttttgctttttcaactctgtggctgtggctgctcgccatgcccagactatcagtgggcatgccctacggtaaggactccctggggaccccccaaatcctgatccttgtggggacctggatgctccccccagcccattgtttactcatgccccatggtccagctcccaggacttccttccccagaaagaagtaagggtgcagtccttacccagagaaggaccgaggatggagcctctcagtgcttatttagataggacccccagatcatgttacctgggcacttacaaaacaggatccagggtcccaccccagcatttctggcctatagcagctgcctcgacagaacccaggtctaggctcctgatgcatactccagaagacccacgaaccagcccccagcattagctgcccaaggcccagggtccagttccctagcaatgacccagaagagcccagggcccagccccgagcacttgctcaggcctaccgggcagcccttgggaaccaggatcagacttttctccttaactgataggacccagggtcctgccactcagcactaaatgcccctgcagaccccaggggtctagcccagccctcttccagggcgtgagtatcgtcggttactgaggtgctgtctcctccccaggatcctgattgtggattgggatgtccaccacggtaatggaactcagcacatgtttgaggatgaccccaggtaagggctgcagtcaggggccgcagtgtgatcagggaggcgggtgagcacctcaggggtactggagcccctaaccagccatggtccgcttcccaccccctccctggcagtgtgctatatgtgtccctgcaccgctatgatcatggcaccttcttccccatgggggatgagggtgccagcagccagatcggccgggctgcgggcacaggcttcaccgtcaacgtggcatggaacgggccccgcatgggtgatgctgactacctagctgcctggcatcgcctggtgcttcccattgcctacgaggtacagctcaggatagatcgcaggacgtatgtgacacgcctgtgcaggtggcagcctggacctgcctccttggcatgtgtgtgtgtgactaccatgtggctgatgatatgagacagcgcatgggtgtttaatgaggctaccagggcagttggtggctgtgatcaccttgtgtatttgtgcacagatggctgtacatgactgccttctctgtgtgacactgtgtgagtgactgtcttggctgtgtgtgtgagggccttctgactatgcaccaatggcccgtgtcctggctggatctgtgttgtatgtgcgtgccatcacaagtgcttgagtatgtgcgtgtgcgactctgtgcaggcaggtatttctcaccttttctctgtgtgatgggtgtgatactgtatgtcactaaatgcaaccatctctgtgacagcctgtgtgggaccttctggatgtggaaggctgtgtgtgacagcagtcactgtctggctgtctgccctggctgtttgtgtgtatgtctctgactgggaggtagctgccttccctctgtgtgagctaggaggctggtggcttgtgtatggctgactctgggagggagggaaagggtgtgagcaccgctctgtcaccctgggcgccggtgtgcatctttggatctgcatgtgcatctgactgtgcatgggtagccaggacagccttctgtgtgtgtacaactgtatgtgcaaataaccagctcttgtggacataccagagtgcatgtcgccgttgtggctgtgtggtgatggcatgtgtatgtgactgtgcaggatggctgtgggttattgtcctctttgagaaactgtgtgtgtgtacatgactagtgcagatatatagtactgatctatatggtactgtctgtgtggcagtacgtgtggctctgtgtgaccatcttctctgtatgtggttcttgcgttgccatcttctgttttggaagtgtgcaagcacctctctttggcactatgtatataaaaccctgtatcttgtgtatgtgtgtcccacgtttgaccctggggtatgtgtgtgtgaggacatgtctctgtctctctgtttttcatgtcactctcttgacgtgtcagtctgtctcatgtccccatctgtccctttttttttttttttgaaatggagtcttgctctgtcacccaggctagagtgcagtggtgcaatctcggctcactgccagctccgcctcctgggttcatgccattctcctgcctcagcctcctgcgtagctgggactacaggctcccgccaccacgtctggctaattttttgtatttttagtagagacagggtttcactgtgttagccaggatggtctcaatctgacctcatgatctgcccgcctcggcctcccaaagtgctgggattacaggcctgagccaccatgcccggcccccatctgtccctttctgccatctccatgtctctaagtctgcatctatttcttctacctctgagtctgtatttcttttcttcccttcttcattttcagtctctgcttttgtgtctcctagtctccaggttctgtgtctccatctctctgacttgcatctccatgtcttcatttgtccttttctccatgtctctgggtcgccatcacttactgcctaccaaaagcccctaccctcatgcttatacatctcttctctccctgcctcagtttaacccagaactggtgctggtctcagctggctttgatgctgcacggggggatccgctggggggctgccaggtgtcacctgagggttatgcccacctcacccacctgctgatgggccttgccagtggccgcattatccttatcctagaggtaactttctcttggtccctcttcccacagtgggagggtagtttggaaatgttggcaccatcactcaggacagtttcctgaaatctcctttgagtgtccctgcctgggattgttggcacatactgggtagtaataagaataacagcaacattaacagccttaattgagtgctcactatgtgcagagcactcttctgagcacctcatgtgtcttattcattcagttacttggcaaagcagccttatgaggtagggtaagcttacctcattattttcctctctgaagatcagggaaactgaggcacaaagaggtgtgatgactagcctgagatggcacatttactgatggcagaaccaggacttgaacccatgcagcctggctccagggtttgtgctttttactctacctgaactgcctctaacaagttcctgggacaaaggaaattcactgacctttgtaaatgactcagtatccccacgccctgtgcctcagtttcctcatctttatgaggcaggctaatcatggaggaatgcctggcatatggtaaatgctggatcttttggatctggttttttgttgttgttgttgttgttgttgtttgtgagacaagagtctcgctctgtcacccaggctagtctgcagtggcatgatctcagctcactgcagcctccacctcccggcttcaagtgatcctcccacctcagcctcctgagtcgctgggattacaggcacccgccaccacgcccagctaatttttgtatttttagtagagatggggtttcaccatgttggtcaggctggtcttgagctcctggcctcaagaaatccacccaccttagcctcccagagtgctggaattacaggcatgagccaccgcacctggcccctggttactgttatgcgttgttcagatattaacccactcagcaaccttctgtgctcttattttctttttctttttctttttttttttgagacgttgtcttgctctgtcgcccaggctagagtgcagtggtgcgattgtggctcactgggttcaagcagttctctgcctcagcctcctgagtagctaggattacaggtgcctgccaccacacccagctaatttttttgtatttttagtagagacggggtttcaccatgttggccaggctggtgttgaactcctgacctcgtgatccacctgcctcagcctcccaaagtgttgggattacaggcatgagctaccatacctgcctctttttttttttttttttttttttccttttgagacagagtctcgccgtgtcacccaggctggagtgcaatggcgctatctcggctcactgcagcctctatctcccaggctcgagcaagcaattctcatgcctcagcctcccgagtagctgggactacaggcgcatgccaccacgcctggctaatttttgtatttttagtagagacgggggtttcaccatgttggccaggctggcctcaaactcctgacctcaggtaaccttcccgcctcggcctcccaaagtgctgggattataggggtgagccaccgcgcccagcctgtgctgttattttcaccactttacagatgaggaaaataagtcactgagaaattaattggcttgcaaaaagtcgcacttactatgtgcccagtactgcttgtgacaggacacggtgggagttaagaacacagatgactccatcagagagcccaagttcaaaccccagtgctgcctcttcagctgttatgacctcggacaagtcatctaaccactctgagcctcagtttctttatctgtaaaaagaatagcaactgggattcctgtagagtgtaaaaaaagtcaatacaggagtccatgtggagaaagagtccagttgttcctgtactaggtcagggcaggggcttttgtatgggttcacagcagtcgtcttgtgcaggtcaggtcagtggttactgtatgatgtgaggccaggggttcctggacagtgtgaagacggatttctgtatggcatgaaggcaagttcctgtatagattgagcgcctgtggttgtgaggattgagttaatatgcatgaagtacttaaaatcgggtctggcacacagcaaacaataaatgtcagctgttactaatgcttttatcagtattgttatcttgcactttacatcacaatttactccccacaacaaccaccttacacagtgggtgctgcctatcttaaaggtgtgggttctgttcacttgttctcagtactccccctccctctccagacttgcagggctcagtagggaggattggggaggcaggacatgttgtcctccaaattccccaatgaacccccaccatacctttccctccccttttccttaacaaagggtggctataacctgacatccatctcagagtccatggctgcctgcactcgctccctccttggagacccaccacccctgctgaccctgccacggcccccactatcaggggccctggcctcaatcactgagaccatccaagtccatcgcagatactggcgcagcttacgggtcatgagtgagtggatttgggggtgatggggggaacccagggaaggagggggctgaggggcagagatcagaggcaggaagggtgacagtacccacactcaaggatctccctccctggttccagaggtagaagacagagaaggaccctccagttctaagttggtcaccaagaaggcaccccaaccagccaaacctaggttagctgagcggatgaccacacgagaaaagaaggttctggaagcaggcatggggaaagtcacctcggcatcatttggggaagagtccactccaggccagactaactcagagacagctgtggtggccctcactcaggaccagccctcagaggcagccacagggggagccactctggcccagaccatttctgaggcagccattgggggagccatgctgggccagaccacctcagaggaggctgtcgggggagccactccggaccagaccacctcagaggagactgtgggaggagccattctggaccagaccacctcagaggatgctgttgggggagccacgctgggccagactacctcagaggaggctgtaggaggagctacactggcccagaccacctcggaggcagccatggagggagccacactggaccagactacgtcagaggaggctccagggggcaccgagctgatccaaactcctctagcctcgagcacagaccaccagacccccccaacctcacctgtgcagggaactacaccccagatatctcccagtacactgattgggagtctcaggaccttggagctaggcagcgaatctcaggtaaggctcaccacacccaggtaggggcaagaaggggcaagaatcgggcttctctgatacatctcttacttctgcgtgtccagggggcctcagaatctcaggccccaggagaggagaacctactaggagaggcagctggaggtcaggacatggctgattcgatgctgatgcagggatctaggggcctcactgatcaggtgagctcagggagaggctgggactgtggcttccttctcttgccaatttgtgtctccaggtaggagcatgtgatgaataaacatataatggggagatggggtcttcagcttacctagtttcacccacccactccaggccatattttatgctgtgacaccactgccctggtgtccccatttggtggcagtatgccccatacctgcagcaggcctagacgtgacccaaccttgtggggactgtggaacaatccaagagaattgggtgtgtctctcttgctatcaggtatggagcagaggaaggggatggggcggaggttggcccgggagcaaactgcagggggatgctgacccccacctgacactcacacccccaacctcaggtctactgtggtcgttacatcaatggccacatgctccaacaccatggaaattctggacacccgctggtcctcagctacatcgacctgtcagcctggtgttactactgtcaggcctatgtccaccaccaggtgggccctgggtagacccttcgacacgtgcacactcaccccccacacacacaccccttctgtgattgggtaaagggagaccacaggcccctctgcatggctgcctcatgtgattattttgcatggggcgggggctgtgggatagtccagaagacagagtggttgagggctggagtgggggcagccctgcagccgaggtagaggggtcctcactctctctcacctgccctattcttgcctcctcctcaggctctcctagatgtgaagaacatcgcccaccagaacaagtttggggaggatatgccccacccacactaagccccagaatacggtccctcttcaccttctgaggcccacgatagaccagctgtagctcattccagcctgtaccttggatgaggggtagcctcccactgcatcccatcctgaatatcctttgcaactccccaagagtgcttatttaagtgttaatacttttaagagaactgcgacgattaattgtggatctccccctgcccattgcctgcttgaggggcaccactactccagcccagaaggaaaggggggcagctcagtggccccaagagggagctgatatcatgaggataacattggcgggaggggagttaactggcaggcatggcaaggttgcatatgtaataaagtacaagctgtt

SEQ ID NO: 2297 - DNA, 1267 bp, Homo sapiens
gcgtgaggagggaaggagagatggggggacgtgggacagggagaaaacaacataaatcatatatatatagcatgcaaattggaaggtgatcagcacacaataggcattcaataaatgttgaaataatgacaccccactgtctccttgccctcaaatggtctcccctaacgtatcccctgttgtcttgcttcttctcttcccacttgcagagcctgctgcccacgtctcttccctgagctgcctgctggggtcatggagctgccaacaaagcctggcaccttcgacctgggcctggccacatggagcccttccttccagggggaaacccaccgggctcaggcacgccgcagggatgttggcaggcagctgcctgagtacaaggctgtggtggtgggcgccagtggcgtgggcaagagtgcgctgaccatccagctgaaccaccagtgcttcgtggaggaccacgaccccaccatccaggattcctactggaaggagttgaccctggacagtggggactgcattctgaatgtgctggacacagcagggcaggccatccatagggccctgcgtgaccagtgcctggctgtctgtgatggtgtgctgggcgtcttcgctctcgatgacccctcgtctctgatccagctgcagcagatatgggccacctggggccctcaccccgcccagccccttgtcctcgtgggcaacaagtgtgaccttgtgaccactgctggagatgctcatgccgctgctgcagccctcgcacacagctggggggcccacttcgtggagacctcggccaaaacacggcaaggcgtggaggaggccttttccctgctggtccatgagatccagagggtccaggaggccatggcgaaggagcccatggcaaggtcctgtagggagaagacccggcaccagaaggccacctgccactgtggctgctctgtggcctgaaggtcttggccaagaaatgtagacctttccccaggccagggtgattgttcatttgacatgagacccctgaggcaactagctttgagggacacatcaggtatactagggaaagatggacatctctcttgttttcacttggtgaggggctttttggtaacatgggagtgcctaatgttgcttttgttatgtcaagttgaaagattttgtgcaaaattaaataaatggtgttttgggtttcaaagctgcctccatgccgagtgttgtgtgggtgggagtgagactgggtagaatgttacttgagttgtgagaattc

SEQ ID NO: 2298 - DNA, 4883 bp, Homo sapiens
gagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacca

SEQ ID NO: 2299 - DNA, 4883 bp, Homo sapiens; identical to SEQ ID NO: 2298

SEQ ID NO: 2300 - DNA, 5227 bp, Homo sapiens
ttgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacca

SEQ ID NO: 2301 - DNA, 8348 bp, Homo sapiens
actaaataaatacaacatctttatttggcattggatatcctgacatttgttcattacagttccttaaaaaacaaaccaaaaaatcagaacaaattaatcaaaaataaagatccaatggctctatttacatatagcaaagacagcccaggcatcttccatgcacacacacaccccgccccgatacagttaaggggttaataagctttggggagcgcaggaggcaggttccacagttcatcaatcccaagacacccccatgaggtaggggtgcctcacacagccagacggatatcaagagtatgattggtagctttttcctctcctagacatctccaaaaataagcctacatctggcaactgacagtgtcttaaatacaatgagattcagccacttcaaggacctccatttttcccacaccctggatcattaatgatatgattacaccacaaatcccaagtccactaaaaaaaacaaatggcccctaccacaccttctgccagaagggctgatgcaaaaatcttagctcttgtccctttctccctggggactcacaagaagcccatcttcaaggtatcaaggaagctggcccaaggccacacaaaagacggaactagtaacatgatccagagcggtggtaagggaggagagaaggcctcaaactatgggcaactgaaccccacaggtaggcatcggtcattcctgaagagctgcgggagttttgtccagtgtgtccttatggaggtggagggactgctgggagggactctcccagacgagaaacctccagaagagggcacagggtcggggagggagcagacaaaaaaaaggccttgaatgacaatacccccaaccctgcctccaaagaggttagagggagcagaggcggcagctctaaaaccccctccaggggaagggggtcaccctaccaggaagggttcacgtgacacccagctctagtcccacacccctccagaagtctcagtgacctgggagaaaagaccatctcccaaacccagaggagccaggccccggagggtggcgacttgggtcctgcagatgcccaacaccctccaccccagtccccctcccttgtgtccccccattgctgccagccctcacttcaccagcactgactttggcagaaagggctccgtgatgaggtctccacggtgggaagacagctgcggtggtggtggctgcccgggaggctgctggtgaacgcagggcccggaggcggaggcagaggcagaggctatggctttggctgcacctcggggaaggctgtagaggtagacagcaccaatgacgagtccagcgccaagggcaaataatgggtccacgtggaagccaaagaggcgaatggaggcaacagtggacagcacaatggacagggaggtggcaaagcccttgaggatattgtcagcgtacttgacaaccacagccaccagtagcccgccgaaggcctggttgagcaccacgccccagacagcaggtgtgtacccaaaaaagaaaccacgggtggccacggcggtaccctcagcccaccagagccccaccaggcccagtgctgtgccgaagaggcccagttgcaggttgcgcagccacacggagcctgagctgcctttgaggatcttctcaaagtagacacctgcgaagccggaggagagacaggaggccacgacggctgccaggcctgccccagggttctgatccagtggccgtgggcctcccccaccggcttgctgtgcctggacaatggcgacgccagtgaagaggagcagcagggaggcccactgcagccgggaaaggctgcgattcagcatgagcacggagaacagcgctgtggtcaggatcttcagctggtatgtcacctgcgagtggcacgtggaaggcactgagggctgaccctggcccccaacaggtgcacatggggggcagcacccactgtgggcccccaggcacaatggagggacagggtggggggtatgacagcaaaaacagcaaaaggagccagccactggccattggctgagctgcagcaaaacagttctgaagtctctcccagcaagtgcacaaaaggatggctgtgccaagaagtccacatcccaatcccatttcctggctgtgtgactggggacaaagcacttgccctgtctgagccctggcatcatcatctataaaagatggctgaggtatggaagtatctttgtgatgagggacttgatacaaatgaatcaatagccacaacaatgtcagcaaatacttacatagtgcttacaatatatcagtgtggttctaggcactgcacgtgaattcattcatttaattctcacaacaccattctgaagtgagcaccactgtaagccccaatttaaaggtgagaaaactaaggcacagagaggttaggtgacgtgccccaaaatcacacagctggaaggtagcagagctgagatttgaacccagacagcctggccccagaatccaggctctttaaccatttcacaaagctgcccacaaatagcctaaagcttatctgtcaccaatcaagggctcttcacaggtattatttcttttaagtatcctagcatctcaatgaacaggcattactatttccacccccaattttcacagacgagaaaagggaggttgaaggagttccaaggacattctgaaggtgacatagcccctgtcctctgcaacacccccccaccacgctattcccatactccagtccccaacccagttagttcctctggggccatgctgggcttggggctcacctggaaagtggcagctggtaggttagagatggcaacatactggaggttattctgcaaggtgtagatgagagagggcactgcgagcttgagcgtgtccacatactgcaccaggacagcctcatggaggaagagaaccaggtgcttcacgttacctaggtgggaggaggagagcccttcttagcactgacagccatacatggggaacccctgaaggctgggaacaggccttgctcctgtgactcccccatccaccctgctgtccaatccctggaggctggaatgaagtatgtgatcttggttttccctagagtacaaccatgtttccagcaagcttttctgagactcagtttaatggcagcaaaagaatcagccatccgtgtctgctaatcacagagcatgtcactcatgttagagcctacctccctggcagagagccccattcagggaaagcactcaatactcaatatatttgtgtacaatgaaataaccagcattaggccaggtgccgtggctcacgcctgtaatcccagcactttgggaggccaaggcaggtggctcatgaggttaggagttcaagaccagctgggccaacaacactgaaaccctatctctactaaaaatacaaaaattagccaggtgtggtggcaagcgactgtaatcccagctacttgggaggctgaggcaggagaattgcttgaacctgggaggtggaggttgcagtgagctgagaccatgccattgcactccagcctgggcaacagagtgagactccatctcaaaaaaaaaaaaaaagaaagaaagaaataaccatcattaacttggagcttatgaaatagaagccctaggagctggggtggagggctgtctcccacacagaagagtttagtctagactttttttttttttggcacagtggcgcgatctcggctcactgcaagctccacctcccaggttcaagccattctcctgcctcagcctcccaagtagcttggactacaggcgcgtgccaccactcccagctaattttttgtatctttagtagagatggggcttcaccgtgttagccacgatggtcttgatctcctgacctcgtgatccgcctacctcggcctcccaaagttctgggattacaggtgtaagccaccacaccaggcatagtctagacttttagacttatcctagctcctcactgacccatgtgccgtctgagggcaggggccatctcccccttgttgcatctttctgtcagccctagacacagagttgcctctgccacatggatgaatgcaggcttgaccattaagcagaagtccgcttgggacctgctccagtgaaaacatgataatcgggctgggcgcagtggctcacgcctgtaatcccaacactttgggaggttaaggtgggtggatcacctgaggtcaggagttcgagaccaggctggccaacgtggtgaaaccccgtctctactaaaaatacaaaaattagccgggtgtggtggcaggcgcctataatcccagctactcaggaggctgaggcaggagaatcttttgaacccgggaggcggaggttgcagtgagccaagatcgtgccattgcactccagctcagacaacaagggcaaaactccatttcaaaacaaacaaacaaaaaacatgagaatcatttcctatgtaacaaggcctttgcaaagctcgccccactttttggcagttcatctttttttttggcggggcggggtgggtgggtgaggagtcttgctctgtcgcccaggctggagtgcagtggtgtgatcttggctcactgcaacctctgcctcccgggttcaagcaattctcctgcctcagcctccctagtagctgggattacaggcacctgccaccgcgcctggataatttttgtatttttagtagagacggggtttcaccatcttggccaggctggtctctaactcctgaccttgtgatccacctgcctctcggcctcccaaagtgctgggattacagacgtgagcaaccacgcccagccagcagttcatcttttaagtcacagctgggtgtcactccacaggcaaaacttcttcaaacactgaacaaggttgtcccaggaactcctactgatgttcattcaccaaaccctgtgcactcctggtctccaaactcgaattcaggggaaaaaaattccgggcaggggagagaggggtgctgaaattgtggctaagagatgaaggcctgtgattaagtctgtggctatctgttatttccatcttccatcagcaatgaggacaagctgctcctctgcattgctaacccatctacccccacggcctgaggcagtgttcacacctacactgttcacagagttaacaaaggtaagagcaggtctcttgttaacctggagttaacaggtgggtgagaatattctcttcaatgtaaacaaagggcaaaggtgcataattcatctccatccctttacttatgcaagacctttttagagaaacaattgggcaacacttcaaagtagaaggccttcagggagatgttgaaattagcagataaacccaacttccaatttacaagagatgtagaagacagaatacttgttaaatttttgagaatatttgccttagggaggcagtcagcaaaatccagactacccaaagtctacaaaacaaatgacctgttttctccaacaaattaattgcaaagaccaaaaaacccctagagattaacagatttagaagataccaaacaaggccagcctggtggctcacgcctgtaatcccagcactttgggaggctgaggtgggcggatcacgaggtcaggagttcgagaccatcctggctaacatggtgaaaccccttctctactaaaaatacaaaaaaattagctgggcgtggtggcacgtgcctgtaatcccagctacatttattcaagataattcaggggaatttacttccatacaatattacttcgtgtgggatttacttaaaaataataagaggataaggacgtaggtagacatatagattggcagtgagtgaacaatcactgatgttgtttaaagcggccatgagttgctaattgctgactctgggggatgggtacatggatattttactatttgattattctctctgattttgcatgtattcggaattctccataatatgaagctaaatcacatgtgagagatccctgctactttataagcattggcaatctcactcctacagcccacacaggccggctacccggctgttagggctagaaaagtgtaagatgccgctacgcatagctggagtggcgctccaggcaggttgagatttggagacactcctgaagcaaaccatctgtgtgaacacacacacatacatgtggagtctcacccaccgaccccagtgcagccccatccctggttcgtacccctcttctgtgcgaagagcagcagcaggcaggtgagacctttgagcacttccgccatgaccacagcagtggtggcaaagaagcggtcccctggcaacgtgcgggcgtagcggatgctgaggatgagggaggcattctggaccaccagcacagctagggatatgtacttcaggcgcctgtgagctgtggggaacggaaggggcaagggggaaggacggggtcagaagccgctggggcatagccacaccaccacccaccccctttctttctcacccaggaccctcctagccatggctacttgctccctcagcctgcctgccctcacccaataagggtctgactcctaccggcttactgcctcagccatgagcaggaagagccagaagggagaaatgggccccaccctgtcccagtccatacctggaatccttactgaggtgtcaggtaatggctgaggcaaaccctggccacgcgcctcggcttcctcccaagtgagaagcaactcttccccagaaagaataccgacaactacattctccacgtttattgagtgtttactgtatgcctatcactgggttaagggatttctatggattacctcaatagactcatatcactgtcatctccaaaagaactgcgaggattcccatttatggattagcaaactgagaatttatatgaaatgatgctcctgtttaatgagggactgtctcatgtaaagaataacacatcaatgcagggaatgaggccactgtatgaggtatgttcaccccctaagaacggtctttctcctatctaagaaatgattcgattccctcacactgagaatggcctacatcccatatggaatgatcctcctcatacccagaatggtctctccaacccctcactcctgtgacaactggttcctctcgaaccagaatagtctactaaatacaagaaatgattcccacatgctcccagggactgaatcctgtatcaggaatggttatcccaccaagaaaggtctggctccctcaaccagatgaggaaatacttccctgcactccacatggtctgccctcccaccaccgcacacggaccctctagctaatgaatttttccttgctctacccacactcacaatgagctctctctgctataaggaaggacccggcactctcagaacgttctttctccaccatataacgatgagccctcccacccgaatgtacaatgaactctacctccattaggagggagcccccagaacggtctcctccgcacataatgaaagacacccccatcctcaaaatggaccctctctagtcacataaagaaggactcgccccaccctaactcacaatagtctctgtccctttataaggaaggaaccaccaccctcagaatagtctcccccttcttcagtgaggaactcccacacccgcagaatggtctcttccacacggaaggactccacatattcagaatggtttcggtggccttagccttcccaaaaagaattacccaccacactcacaatggtctctactctccatatgcggaaggatcccacaatcactctcagaatgttctcttccccgcccccaacacactgacaatgtgcacacacacacacacacacacgtcggtccacacgggatgctccctctcactttagtgaggaacattcccgactcccagcgatcccgacctccgcctcccatgcgactgctcgggcagactgtctcacccgcactggcggtccccggctccaatgcacccgcggaaaccgcccctggcccgggcgccgcggtggaaccaccagccccaaccgctgccatgttggcatctgcccggcccgtcccctcggcaacagaaaaaccacttccgcgttcgtcacttccgctgccgggccacctgagtgaaggtggagcgagagccgggatcgtcagggtggtggcttttctcctccgctcctaaaagctcaatgtatgaatagccccgggatttccaaattccgtcggatcgggaggccggggacacggcccgatcggcctacccaccatccctacagagcttcatcggcccattcctgtcactagacccgccttatcctgccgttcgtccgcttcactgatcgcgctttccagatcatcccccgat

SEQ ID NO: 2302 - DNA, 5227 bp, Homo sapiens; identical to SEQ ID NO: 2300

SEQ ID NO: 2303 - DNA, 5956 bp, Homo sapiens
cttctgattctattacttttattaaatagtgggtttccacacatggctttttaaataatccaggcaggagaagagaggagggcacacttggaactcccctccccacaatacgtgattatttacattttagtaattggacaatcccggctcaggaggaggttgcaagaatctgcaaaagttggagggagcgccccaggagaacaaacagcaagccttatttcccctagcccatcccccaaaaaaccatccatcccatcctagtgtctggtggtgtccggtggtgtccatcttccattccttcccaaattatggaagtaaggttcttctcaccagaataagagcacttgggataacagagtagggtcccctcacccaaaaaaaaaaaaaaaaaaaagaagccttggggtaacaacagggcattacctcccccagaataaagaatcctgggctgaggcaggtaagcagcttgacccaatatgggaccctaggctaggggaaagggtccctttactaaaataaaagctactggggtattggaaggaaagcacccttgcccaagtaagagcatatgaactaagtttgtgtggtggtagtaggaggtgccaatgtggggtgacacatcatcagaataagagtcccggggctcagaatgggaacaacttcaccaaaataaacttccttagcaaaatgagaagcaagaagttccccctccagaatcagggaccacaggttctgggaggaaggctcctttgtaggattgggaagggaactgggcagacttggtttatgtcttctaacccctgatcctcaatcccttaccttagtaatactggactttaatgactggtaatgacctgtaaaaccaagtcaacaaatgtccatctatccctgtgacatggccatgggatggctcttctgaccattgggggccaggccaggccaggccaggcttagggtagcaaggaccaggccaaaggggcagggcctcctttggaggggttgaggggtacatcctcggctggtgtttgcatccaggggtccagcaggatctcttccagtgagggtcgggaagaaggtttgggggccaggcaccggcggattagggcacagcagtctgtaggccaagaagcagagagggaagattagcagtcagtagggggtactggtccctgagaaggatggagtcttctgggctggggtcagtgaggcctcacctggggagacatgggctgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtccctgcacacaagccaggggttagaccaactcaatctcatgatgcccttctccaaccccaaactctccaggaaggatggcctcaccacaattaagagcactcaagataaaagcagagtcccctcactagataaaaagcagctaaaataacagagtcccctcaacagaataaaagcactgaaaagtaacaggatccccttaccagagaaagaatactcaggatggtaacaggatcccctcaccagaataggagcccagaataaggttagcacaccattaaaagatggactttatcagagggcaaggctgagaatccccagtattagcaatcgatcatcttatataatgcagtatgggtcaaggattacaggacaccccaccactggaggccaaaggtcacaaggccatcaagtaaaaacaatccctccagggagatttagagaagccttaccatcaaagtcagtgtagggttcatcatgaagcagggcaccagaaccaaaatcaatgagtttggcacagccacggcgtaggtctatcaggatgttctcatccttgatgtcacgatggacaactccacgggaatggcagtgctggatggctgccactacttggccaaagaagcagcggcttgggccttcacccagtgggcccttctctgtgatatagtcaaagagatcctgggcgggcaaaggccgctcgaggaccagcatgaagccctcctgtgtctcaaaccagtcaagcaggcggatcacgccagggtgcccaccacctgcacccactttccatagcagtgcgacttcgagtgggcatgtgactgagtctgactgggggcacaggtggggtgggaagcagggagagaaaaaagacagatgtcagggcaacagctctgaggctttttacctaagctcaactcagggccccttttcctgacagtgtgtcgctaagcaactcacttcccttcctgggcctcactttccctaaagacacaaactcacacagcgattgagagggtgaaaccagcaaagagcctgcacaaatctcgcatgtcgtagatcaataaacatttgaataaacgaaagaagttcggccaggcacagtggctcatccctgcaatcccagcactttgggaggctgatgtgggtggattgcttgagcccaagagttcaagatcagcctgggcaaaatggcacaaacacaaaaattagccaggcttggtggcatgcacctgtagtcccagctacttgggaggctcaggtgggagggtcgcttgagccaagaaggcagaggttgcagtgaagatcacaccactgcactccagctgtctcaaaacaaacaagcaaaaatacaaagaaaaatctggttatcaactgaaggctttcagcagaagcagcaccaccattatgtgttttgttttgttccctgacatatcccagattagaatagtaccttacacaggtgatcaataaatgttaaacagatgacagcacttaatagcatgggctctgacaagcagttagcactcaataaacacttattgtgtaatggtttgttttgttcacggacgtatatgaagcactagaacagtggctgctaacagagtagggctgaataaatatttgttaaacaggtgaaaacaattagtaaaaaaggacctagcacaaaatgagctctcaatacttatgtaatactttgctgagtgtctagaattatgtctgtcatatagtaggtggtcaatatacctaatttgttaaacagctgagtgatttattacaaaggacctagcacaaaaggacttagtgttatcatgtgttttgtcagcatcaccaagcacctagaaccagccaataaaaagcctaaatgtggccctgcgcagtggctcacgcctgtaatcccagcactttgggaggccgagacgggcagatcacctgaggtcgggagttcgagaccagcctgaccaacatggagaaaccccgtctctactaaaaatacaaaattagaggctgggcgcggtggctcacgcctgtaatcccagcactttgggaggcccaaggcgggcagatcactaggtcaggggttcgagaccagcctggccaacatggtgaaacacggtctctactaaaaacgtaaaacttagccgggcatggcagcgggtgcctgtaattccagctactcaggagcctgaggcaggagaatcgcttgaacccaggaggtggaggctgcagtgagctgagatcacgccactgcactccagcccaggcagcagagcgaaactccgtctcaaggaaaaaaaaaagtcataaatgcagccgggcgtggtggctcatgcctgtaatcccagcactttgagtggccgaggcaggcggatcacctgaggtcagcagttcaaaacccgcctggccaacatggtgaaaccctgtctctactaaaaatacaaaaattagccgggcatggttgtgcgctcctgtagtcccagctacttgggaggctgaggcaggagaatcacttgaacccaggagacggaggttgcagtgagccgagatcgcgtcacctcactccagcctgggcaacagagggagactgtgtctccaaaaaaaaaaaagtataaacgctgggggccacaaaatccgccccccactgcctccccaagccctgcgcaggtacacttcgagcagcaaccttctgggatgaggtagagccctctcctggccaggctgctgacttgcacggcagcagacgttttctcaccgagatgcaaaaataccgatattgcgcaggcgcaccctctccctttgggtcccatggactgcgcaggcgcagtttcccctagagcccgccagggggcgctcccaactctacaacttgcccagacccgccctgatgtccgttagcgttataacggcaagagagaagcagccaccatcaccatggcaaccagtgacctctgccccttgttccccaccagcacgccctgcgggcagtcccccagcagtgtttggaggaaggatggtaaaggtttgttggaggggagaatccagggctctaggggaattggggtgaatcagaactgtatgtcaccccaagggagtataaatggactggcagtattctcactgttacagggcccagggagtcatacatcccctggaaaagcaaggaggtgaatacatcagtgatggagtaggtaggttaggaagggctccgaaggtactcaccaagggggaccagcccagcacacgattccggggaatcactttgatggccacctggagaagaaggccgtgataaggaggccagcaggtgatccccagacccctcccagtctagaccttctgcctacctccagtattcctccatctaccagcactctagtctttctggtccccaaccacagcaccccacagaacgcgtaccagggcgtctcccctgccctccaggtcctcggaaccaagtttatctctcccaccttccttagccctgggctctccgttctcaggcatcaggactcatcactccaagtcctgagttctagatttcctgataccccaggcccacaatcttcctatttagctctacgacaccccaactctgtaccagggtcctggtccgcatgactccacactggacacctacctccaaaagtcccacaaatctcacatctaggtccctgctttcccacacatacacagcctggaccccggggtcaaggaactccggaatctgaagccccctgccccccccccccgcccataacctcctagaccgacacacacacgcgcacgcacacacacctggccctctacacacactgcaggctcactcctcggacacggacacggacacacacacacacacacctggtcctctacacactctgcaggctcactcctcggtcaaccagcattccagggccaggacccccgcccccgccacacgcacctgaccctcccaagaccctcatgacggatacctggagtcgatctgtgaggcggtgtcctgcgaagacggtgccaaagccccccttacccaggagggggccgagtcgatactcggcctcgaacgcttcccgatccttgcctcctacgcaggcggaggcgaggaagtcagggtggcggcgtgctgagcccagccacgactccctccccccgcgctgcaacccatcattccagcccaccccgtctggttgcagtaggggaggatgtactcacctggcggcggcgtgggggtcccggggggcgcgggaggcccctgtagaggcttggtcaacatggaggtggcgctgcgcagattgagcccactgaacccgctaagcccgcagggcgtggacgcccggggcagcgcagctggggagccagggctggggggcgccagggtggaaagcagagaaactggtggcccggaagcgcccgcagacggcgcagcgttgagattcgccgcgcgcgccagccccaatgctactgagcctgggcacgcgcctcccgggagagtcaccctgggcgacagccccgcccacctggctttgatcaatccggacgcggcacctgctgtaccacagccaatcggagccagtt

SEQ ID NO: 2304 - DNA, 5227 bp, Homo sapiens; identical to SEQ ID NO: 2300

SEQ ID NO: 2305 - DNA, 5227 bp, Homo sapiens; identical to SEQ ID NO: 2300

SEQ ID NO: 2306 - DNA, 4647 bp, Homo sapiens
ggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacca

SEQ ID NO: 2307 - DNA, 5229 bp, Homo sapiens
ttgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccaccata

SEQ ID NO: 2308 - DNA, 5209 bp, Homo sapiens
ccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctcccccatcccagcgctttggtttctcccacccggcagtcatggggacgctggatgagcccatttctgaagtgcggaggggccgggcttcttaggctgtgggcggagcctgggcctgggagaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctggtgagacagctaaaagcagatggtcctaacacgtgccagcctcgacaggcacttttgttgttgatactgacgcttgatacctagcatgggccaactgtgcaccaagcaatggggtggcaggcatttttcgttgttaacaatgtggattcctgacatccatccctaccgcgtgtcaagtggagggggttgggggaatagatatttcattctttttttttttttttttttttttttttttttttgaggcagagtcttattgtgcacccaggctggagtgcagtggcgcgatctcggctcactaaaacctccgccttccaggttcaagcgattctcctgccttaacttcccgagtagttgggactacaggcacgccccgccccaccacacctggcaatttttttttttttttttttgagacagagtctcggtctgtcgcccaggctggagtgctgtggcgtgatctcgtctcactgcaacctccgcctcccgggctcaagcgattttcctgtctcagcctcccaagtagctgggattacaggcacgtgataccacacccggctgatttttgcatttttagtagagacgggtttcaccatgttggctaggctggcctctaactcctgacctcaggtgatccaccccccacccttggctttccaaagggttgggattacaggcataagccactgtgcccggcagatatttcattcttaacaatactgactggctgggcgtggcggctcaagctggcattcccagcactttaggaggctgaggcgggtagattgcttgagtttagggattaagagattagcctgagcaacatggcaaaaccccgtctttacaaaaaatacaaaaattaatcgtgtgttgtggtgcatgcctgtagtcccagctacttgggaggctgaggtgagaggatctcttgagcctaggatgtcaagggtgcagtgagccgagattgtgccactgcactccagcctggccgacacatggagaccctgtctgaaaaaaatccaaaaaaaacaacaaaataatactgaccacctaatgcctatttggggcctactgtatgccaagttaaatcccatggattactctatgggggtgatgacatagtatctaataggaagtactgctaacctctactgctgtctcctgtgtgccaagcgtagttgcagtgaggatctatcatttaggcctactgtgctctggctgcaaatcacaccttattatcagtaatactaaaaactggcatctatttggggctatagtgtgccaggcactggaaaatatatcttctccttattgataactgacatctattacaagcctactgtgtgcaaggtatagaccttgtggttaataaaattgtcaatgatcccaggccgggcagggtgcctcatgcctgtaatctcagcgctttgggaggcggaggtggacggatcacgaggtcaggagatcgagaccattctggctaacagggtgaaaccccatctctaataaaaatacaaaaaacttagccgggcgtggtgccagatgcctgtagtcccagctactcgggaggctgaggcaggagaatggtgtgaacccggaaggcggagcttgcagtgagccgagatcatgccactgcactccagcctgggcaacagagaaagactccatctcaaaaaaataaaactggcaatgatcattgatttactttttttttttttttttttttttttttttgagagagtctcgctctgtcacctaggctggagtgcagtggtgcagtcttggcccactgcaacctctgcctcccgggttcaagcgattctcctgcctcagcctcccgagtagctaggaccacaggcgtgctccactgtgcctggctaatttttgtattttttagtagagatggggtttcaccatgttggccaggctggattttcttttaagcctattgaatgacctgtgcctatggtatatatattatttattatttgtttagagacagggtctcactctgttgcccaggctggagtgcagtggcacgataatagctcactgcaagctcaaagtcctgggctcaaatgagcctcctgcctcagcctcctgagtagttgggactacagacgtgtgccactgtgcccagctaattttttttttttgtagagacaggggtctcactatgttgaccaggctagtctcacagacgggttttcaccatcttggccaggctggtcttgaactcctgacctcgtgatccacccactttggcctcctaaagtgctgggattacaggcatgagccatcacgcctggccaagatgagtaaattttttgatgaatccctatcaactctgaaaccagatagctttggctaacagtagaactcatcatctgaacccagacacagatttaggtaacctttttttgtaaacctcctaatatagagagttggatttggaatgtgaaagatacttcatattcttcccggcacacacacacacgtgtcttttatgtgtggcttgtgtgaatgtgagtgcgtgtctctaggctctacatgtaggatgaggtcccctggtccttatctgctctcctcatccccaccttgttctaccagaaccagaggaagagatcattgccgaggactatgacgatgatcctgtggactacgaggccaccaggttggagggcctaccaccaagctggtacaaggtgttcgacccttcctggtgagcctgggtgagggggagctaacttctggcttcacccttcctgtgctgaccttggttgtgaggtttagggggacacaagggagggagcctcgggtggagggtgttggcattaggtatctgcaggactcaagttgctgcctgctggggcctggctcctctggggttggaagactgtcttttctctcttttttgaaacggagtttcactcttgtagcccgggctggagtgcaatggtgtgatctcggcttatggcaacctccgcctcgtgggttcaagcgattctcctgtctcagcctcccaggtagctgggattacaggtgcacaccaccacacccagctaatttttgtattttttgtagagatggggtttcatcatattggtcaggctggtcccgaactcctgacctcaggtgatccgcctgcctcggcctcccaaagtgctgggattacaggcatgagccaccacgcccagctgacagtgttttctcttcaggagaagagattctggggatcctgcctgtggggtcctgacatggggcaggtataggcagagactggggagacaagagttgaggatccaaggcaaggacatctgtgctgacacttctttcctgcggccccacagcgggctcccttactactggaatgcagacacagaccttgtatcctggctctccccacatgaccccaactccgtggttaccaaatcggccaagaagctcagaagcagtaatgcaggtgagttggcaggtacaagcgtgccttgagtgatcttagcagttctcacggagaggccaagtagaatgatagtggatcagaggggcaggtgagaccaggcgggcccagcctcaggcaagggaggttgttgaaggcagaggctgctgggtcctggggtggcaagaggtcacttcaagacttgtgtccccagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaagggtaagctgggcagaatggggctcggtgagaccaacaaggtgcagggtgcactgcgtgaggaagccttccctcaaaaagatgcctggacctggggctagaggagggtgctgtggtacatggcagccaggggcttcatttcttcttgtggggtggggctcagtgatcaggggctcctggtgcctctattgaagactttgccctgccacttccacagcagtaagccgaaaggatgaagagttagaccccatggaccctagctcatactcagacgccccccggtaagtgacaacccctcttgactcagtacgtggacaccatcctccggcctccttcctccattcctcattgggaccaggtgggctgtgtccgccacatcacccatccccatcccctgactctttcaccggcaggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacca

SEQ ID NO: 2309 - DNA, 4698 bp, Homo sapiens
ataggcatttcaaaacgggctttaaatactcatcagggtgccacacaaaggagctggggtgagaacttcgtacatgtgagtgtggggctggggtgccctgagagagaaaaaggggacccatctgtcagggcagctggggtgccccacccccaccctgggactagggagcagagtagaaaccctctctggagggtcccagggctaactgggagccagccctcccttcgaggtagaccatcggggagggaaccgagaagtagctcccatggtggcagtggcttcctcagtggtactgctgatagctggggtagcctggggccggggtgccatccttagggggcagctggctggggtcctccaggaatgggggcgctggagaagggagacttgggtaaggatgagtggaagaggccaggtggagtatttcccactcccccgaccaccagttactcaccatttcggaactgctgggctgtgtagcgagtgaggaggatgccaacgccctcaatgagggccaacaggatgccccccatcattgctgagcccaccatggccagtgggccacctgggggagttggaggcagagaaacagaggtgagagcaggcagaacagggtggaaggggctggggccagggccaggggtcactcactgcgggcagccagcacagccccggtcaatgctccactggtgatagagttccagggatcctccttgccccgaagccgcaccaggccacagtcaatggtggagaacaggcccccccacactgcgaagctacctgtagtggaaccgaggcctaattagttcctgggaaatcctgagaattcacatctcaggggacttccaaggcctgaatgctttggccaagaacagggagaaaaacccagacacaaaggcagatagcaaacccacacagagtatttcctatctgtccccatcctgtggtagctcccacttcaagccgtctataatcaccatcaacattcccttcatctttatggggagttgacaaatgtttacaagcagatttatcttcatatggcttttaacagagcaactttgagcttcataatcaccacacagagttggaattctgatttgggtttcagtgagaaggaaataggttaggaaacccagttaatatgatagttaaaatgtttactgagggcttactgtgtgccaggacctgttcgaggtgctctgttatttgacttctgcaattttaaattagttaatgttattaaagtgtttagcatagcaaccagcacttagtagtatgtaaattacataaactataaaactaccgatgaaatggttactgttatcaccacccccacggtacaagtgaggttcagagaggttaagccactagcccaaggtcacatggcagggaacagtcaggacctagatttaaactccagaacccactttcttcccctccatattcaattgttgggaaacatcacccccctagaaagtctctggcaggggctagaatctgaacccctaacttgcagcctagacccaaaggatcaaccactcccacctttgccaagacatctcctatatctatctccccaagtccctcacctccaatctggggggctcggatcctcacagcattggcactacctctcaaccggtgccgaattccctggggaaaggaaggaagggcgttagggcagggctgaagccactggcagacacgtttccaacttttaagagagggaagaagatgggagacctgttagaggtatgagctgtagagatgtggagaagtggccaagaactagtggcctggagagcgccccaacatgggtgttctcagagctaggttgagaagtgctaattcattcatacatttgttcattcattcattcagtgaatgattaacaagtacctactatatgtgccaagcaccatgccatatgcagggatacagccatgaacaaggtaggtctgctctctgccctctcagagctcacattaacggtgggagacacagatcttgagcaagagtagataaacaagggagcttcagacagcaatctgcactgtagaggaaatgccatgaagaaatatgactggggctgaggggtcaggaaaggcctcttgaaggagggggaatctgtgctgagaccttgaggatgacaaacttgggcaaagatccagggaggagagttccaggagtctaggggagggacggggctacatatataaattgcagagaccttggctaatagatggcatttaaagtcatggcatttgcgatcttctgggaggggaggtggtcagagaaaaagaattatgttaaaagaattctctcaacttcaaggctgtcttccgtctgccaattaaattcctgtcattttcctctatccgggtttctgagccagaatctgcctctaggtaaaatgcgcagtggctaacacctgtaatcccagcactttgggaggctgaggtgggtggatcacttgagttcaggaattagagaccagcctaagcaacacgttgaaaccccgtctctacaaataaataaatacatacataaataattagccgggcatggtggcgcagtcctgtggtcccagctacttgggaggctgaggtgggaggatcacttgagcctgggaggcggaggctgtagtgacccatgatcaggccactgcacgccagcctgggcaacagggcaagatgctgtctcaaaaaaaaaaaaaaaaaaaaaaacatggccaggcacagtggcacacgcctgtaatcccagcactttgggaggccgaggtaggtggatcacctgaggtccagagttcaaggccagcctggccaacatagtgaaaccccatttctactaaaattacaaaaattcgtcaggtctggtggcacatgcctgtagtcccagctacttgggaggctgagacaggagaattgcctgaacccaggaggcagaggttgcagtgagccaagagcgtgccactgcactctagcctgggcaacagagcaagactgtctcaaaaaaaaaaaaaactgtctggctttgcacatacatttaaaatttggtgatgactctttgaacgacacagcatttccacagaggagctccagttgggtggggtggagggtggaagacagaggccatgtttgcaatccctacaaaatcccagatacaggagccaggctcggcacatagtaggtgagtgggcaccagaatgaataagtgcacgtgactggcagctccaagcagttttcagagcagcctcccttgtgggcaagatagctaaccccacaccaacccagggaaggcctggactcacaacaggggcattgcggaaacccttgatggcctggaagactccgccaccgatgacacccatagtgaaggctccaccgcaatcatccacaattcgccatgggctgcaagcaggaagggaaggacggggttaatgtgagccctcccccaggtcctgtcacacgaactcttttctaactgggagaaaccaagtcaccagaatgggaagttcctaagtaggaacaaacacttcagataataatgagctagttctgtcacgctttttccacacacccccccattaaagcgagaaatggggcaaagggggagaaatattagtcttcgccctgtctaccaaccaaggaatcagccaacggttttactgtgatcaaagattaaatgaattggcacacgcagagttgacgtttcaataagcgacataggcgtgttaactagccaagacagactgtcagcaaagcaggaccgcgtcgcaccccttctccgacggtgagcccgtccaaccatgccccgccccttttcaatccggcacaactgggaaaaaccaagagcgaccgcgggaagcatccaccgtccccgccggccctcaacaggttcatccgtgccccgccccccactgacaaaggcgacctgggaaaaaccactggcggcaactctggggatttccggtcaacaccgtaccacccctagccgggatggatcgtccagcgtgtcttttttcgttaacagggctaggagattacgaagtcaggagaaacatggcgtggttcggccttcgccgcaccttctctggttgtggcccctcataacggagcccgaatgacaggaaccgagtgggggtagcgggagatacgttaagagtcccccgagtctggtacatggctctgtgcggccgatgcctcccccgcccgacccccacggctggccttggcgtcgcagcaatattccggatgcctgtgcccattgccgtaccagggctcccgagcgtactcctccatggcgctggcgtctggccgcgcagtcaggccacgcccccagcgtagacgcacaccggcgtcggagctttccgcctattaccgggcagcgattgggtcgctataccgcatgtcacgccaaggacgcactctcattggccaatcgagtttctgccatttgttcattgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtgggtgcactcttttggagctggaggaagtgctgccctctgctccccca

SEQ ID NO: 2310 - DNA, 4698 bp, Homo sapiens; identical to SEQ ID NO: 2309

SEQ ID NO: 2311 - DNA, 8460 bp, Homo sapiens
cggcaagatacacaacacattttatttgcaaaaactcagctaagagatagtgtggagctggcaggggctggggggctgagctgaggtgggtcatgagagagcttagtcatgttggccctgggtggggcaggggtggtggggacagggagtccagtgtctacctcactctacccctaatactgatcagagtttggtcccagctgggccaagggcaagaagagagaacgaggccaggccaatgtcttcaatcccagcggctaggaacccttcaccttggtgagcaacctgtggtgggaatggggaggaaagaaaaacacaaagctgggctaggctggcaggcgggtttcctgagcaagtgagggcggcggtggtgaggctggtagtcctggggttagtaatggtgcccacctggtcagaaagctacacgtggactaaataaatacaacatctttatttggcattggatatcctgacatttgttcattacagttccttaaaaaacaaaccaaaaaatcagaacaaattaatcaaaaataaagatccaatggctctatttacatatagcaaagacagcccaggcatcttccatgcacacacacaccccgccccgatacagttaaggggttaataagctttggggagcgcaggaggcaggttccacagttcatcaatcccaagacacccccatgaggtaggggtgcctcacacagccagacggatatcaagagtatgattggtagctttttcctctcctagacatctccaaaaataagcctacatctggcaactgacagtgtcttaaatacaatgagattcagccacttcaaggacctccatttttcccacaccctggatcattaatgatatgattacaccacaaatcccaagtccactaaaaaaaacaaatggcccctaccacaccttctgccagaagggctgatgcaaaaatcttagctcttgtccctttctccctggggactcacaagaagcccatcttcaaggtatcaaggaagctggcccaaggccacacaaaagacggaactagtaacatgatccagagcggtggtaagggaggagagaaggcctcaaactatgggcaactgaaccccacaggtaggcatcggtcattcctgaagagctgcgggagttttgtccagtgtgtccttatggaggtggagggactgctgggagggactctcccagacgagaaacctccagaagagggcacagggtcggggagggagcagacaaaaaaaaggccttgaatgacaatacccccaaccctgcctccaaagaggttagagggagcagaggcggcagctctaaaaccccctccaggggaagggggtcaccctaccaggaagggttcacgtgacacccagctctagtcccacacccctccagaagtctcagtgacctgggagaaaagaccatctcccaaacccagaggagccaggccccggagggtggcgacttgggtcctgcagatgcccaacaccctccaccccagtccccctcccttgtgtccccccattgctgccagccctcacttcaccagcactgactttggcagaaagggctccgtgatgaggtctccacggtgggaagacagctgcggtggtggtggctgcccgggaggctgctggtgaacgcagggcccggaggcggaggcagaggcagaggctatggctttggctgcacctcggggaaggctgtagaggtagacagcaccaatgacgagtccagcgccaagggcaaataatgggtccacgtggaagccaaagaggcgaatggaggcaacagtggacagcacaatggacagggaggtggcaaagcccttgaggatattgtcagcgtacttgacaaccacagccaccagtagcccgccgaaggcctggttgagcaccacgccccagacagcaggtgtgtacccaaaaaagaaaccacgggtggccacggcggtaccctcagcccaccagagccccaccaggcccagtgctgtgccgaagaggcccagttgcaggttgcgcagccacacggagcctgagctgcctttgaggatcttctcaaagtagacacctgcgaagccggaggagagacaggaggccacgacggctgccaggcctgccccagggttctgatccagtggccgtgggcctcccccaccggcttgctgtgcctggacaatggcgacgccagtgaagaggagcagcagggaggcccactgcagccgggaaaggctgcgattcagcatgagcacggagaacagcgctgtggtcaggatcttcagctggtatgtcacctgcgagtggcacgtggaaggcactgagggctgaccctggcccccaacaggtgcacatggggggcagcacccactgtgggcccccaggcacaatggagggacagggtggggggtatgacagcaaaaacagcaaaaggagccagccactggccattggctgagctgcagcaaaacagttctgaagtctctcccagcaagtgcacaaaaggatggctgtgccaagaagtccacatcccaatcccatttcctggctgtgtgactggggacaaagcacttgccctgtctgagccctggcatcatcatctataaaagatggctgaggtatggaagtatctttgtgatgagggacttgatacaaatgaatcaatagccacaacaatgtcagcaaatacttacatagtgcttacaatatatcagtgtggttctaggcactgcacgtgaattcattcatttaattctcacaacaccattctgaagtgagcaccactgtaagccccaatttaaaggtgagaaaactaaggcacagagaggttaggtgacgtgccccaaaatcacacagctggaaggtagcagagctgagatttgaacccagacagcctggccccagaatccaggctctttaaccatttcacaaagctgcccacaaatagcctaaagcttatctgtcaccaatcaagggctcttcacaggtattatttcttttaagtatcctagcatctcaatgaacaggcattactatttccacccccaattttcacagacgagaaaagggaggttgaaggagttccaaggacattctgaaggtgacatagcccctgtcctctgcaacacccccccaccacgctattcccatactccagtccccaacccagttagttcctctggggccatgctgggcttggggctcacctggaaagtggcagctggtaggttagagatggcaacatactggaggttattctgcaaggtgtagatgagagagggcactgcgagcttgagcgtgtccacatactgcaccaggacagcctcatggaggaagagaaccaggtgcttcacgttacctaggtgggaggaggagagcccttcttagcactgacagccatacatggggaacccctgaaggctgggaacaggccttgctcctgtgactcccccatccaccctgctgtccaatccctggaggctggaatgaagtatgtgatcttggttttccctagagtacaaccatgtttccagcaagcttttctgagactcagtttaatggcagcaaaagaatcagccatccgtgtctgctaatcacagagcatgtcactcatgttagagcctacctccctggcagagagccccattcagggaaagcactcaatactcaatatatttgtgtacaatgaaataaccagcattaggccaggtgccgtggctcacgcctgtaatcccagcactttgggaggccaaggcaggtggctcatgaggttaggagttcaagaccagctgggccaacaacactgaaaccctatctctactaaaaatacaaaaattagccaggtgtggtggcaagcgactgtaatcccagctacttgggaggctgaggcaggagaattgcttgaacctgggaggtggaggttgcagtgagctgagaccatgccattgcactccagcctgggcaacagagtgagactccatctcaaaaaaaaaaaaaaagaaagaaagaaataaccatcattaacttggagcttatgaaatagaagccctaggagctggggtggagggctgtctcccacacagaagagtttagtctagactttttttttttttggcacagtggcgcgatctcggctcactgcaagctccacctcccaggttcaagccattctcctgcctcagcctcccaagtagcttggactacaggcgcgtgccaccactcccagctaattttttgtatctttagtagagatggggcttcaccgtgttagccacgatggtcttgatctcctgacctcgtgatccgcctacctcggcctcccaaagttctgggattacaggtgtaagccaccacaccaggcatagtctagacttttagacttatcctagctcctcactgacccatgtgccgtctgagggcaggggccatctcccccttgttgcatctttctgtcagccctagacacagagttgcctctgccacatggatgaatgcaggcttgaccattaagcagaagtccgcttgggacctgctccagtgaaaacatgataatcgggctgggcgcagtggctcacgcctgtaatcccaacactttgggaggttaaggtgggtggatcacctgaggtcaggagttcgagaccaggctggccaacgtggtgaaaccccgtctctactaaaaatacaaaaattagccgggtgtggtggcaggcgcctataatcccagctactcaggaggctgaggcaggagaatcttttgaacccgggaggcggaggttgcagtgagccaagatcgtgccattgcactccagctcagacaacaagggcaaaactccatttcaaaacaaacaaacaaaaaacatgagaatcatttcctatgtaacaaggcctttgcaaagctcgccccactttttggcagttcatctttttttttggcggggcggggtgggtgggtgaggagtcttgctctgtcgcccaggctggagtgcagtggtgtgatcttggctcactgcaacctctgcctcccgggttcaagcaattctcctgcctcagcctccctagtagctgggattacaggcacctgccaccgcgcctggataatttttgtatttttagtagagacggggtttcaccatcttggccaggctggtctctaactcctgaccttgtgatccacctgcctctcggcctcccaaagtgctgggattacagacgtgagcaaccacgcccagccagcagttcatcttttaagtcacagctgggtgtcactccacaggcaaaacttcttcaaacactgaacaaggttgtcccaggaactcctactgatgttcattcaccaaaccctgtgcactcctggtctccaaactcgaattcaggggaaaaaaattccgggcaggggagagaggggtgctgaaattgtggctaagagatgaaggcctgtgattaagtctgtggctatctgttatttccatcttccatcagcaatgaggacaagctgctcctctgcattgctaacccatctacccccacggcctgaggcagtgttcacacctacactgttcacagagttaacaaaggtaagagcaggtctcttgttaacctggagttaacaggtgggtgagaatattctcttcaatgtaaacaaagggcaaaggtgcataattcatctccatccctttacttatgcaagacctttttagagaaacaattgggcaacacttcaaagtagaaggccttcagggagatgttgaaattagcagataaacccaacttccaatttacaagagatgtagaagacagaatacttgttaaatttttgagaatatttgccttagggaggcagtcagcaaaatccagactacccaaagtctacaaaacaaatgacctgttttctccaacaaattaattgcaaagaccaaaaaacccctagagattaacagatttagaagataccaaacaaggccagcctggtggctcacgcctgtaatcccagcactttgggaggctgaggtgggcggatcacgaggtcaggagttcgagaccatcctggctaacatggtgaaaccccttctctactaaaaatacaaaaaaattagctgggcgtggtggcacgtgcctgtaatcccagctacatttattcaagataattcaggggaatttacttccatacaatattacttcgtgtgggatttacttaaaaataataagaggataaggacgtaggtagacatatagattggcagtgagtgaacaatcactgatgttgtttaaagcggccatgagttgctaattgctgactctgggggatgggtacatggatattttactatttgattattctctctgattttgcatgtattcggaattctccataatatgaagctaaatcacatgtgagagatccctgctactttataagcattggcaatctcactcctacagcccacacaggccggctacccggctgttagggctagaaaagtgtaagatgccgctacgcatagctggagtggcgctccaggcaggttgagatttggagacactcctgaagcaaaccatctgtgtgaacacacacacatacatgtggagtctcacccaccgaccccagtgcagccccatccctggttcgtacccctcttctgtgcgaagagcagcagcaggcaggtgagacctttgagcacttccgccatgaccacagcagtggtggcaaagaagcggtcccctggcaacgtgcgggcgtagcggatgctgaggatgagggaggcattctggaccaccagcacagctagggatatgtacttcaggcgcctgtgagctgtggggaacggaaggggcaagggggaaggacggggtcagaagccgctggggcatagccacaccaccacccaccccctttctttctcacccaggaccctcctagccatggctacttgctccctcagcctgcctgccctcacccaataagggtctgactcctaccggcttactgcctcagccatgagcaggaagagccagaagggagaaatgggccccaccctgtcccagtccatacctggaatccttactgaggtgtcaggtaatggctgaggcaaaccctggccacgcgcctcggcttcctcccaagtgagaagcaactcttccccagaaagaataccgacaactacattctccacgtttattgagtgtttactgtatgcctatcactgggttaagggatttctatggattacctcaatagactcatatcactgtcatctccaaaagaactgcgaggattcccatttatggattagcaaactgagaatttatatgaaatgatgctcctgtttaatgagggactgtctcatgtaaagaataacacatcaatgcagggaatgaggccactgtatgaggtatgttcaccccctaagaacggtctttctcctatctaagaaatgattcgattccctcacactgagaatggcctacatcccatatggaatgatcctcctcatacccagaatggtctctccaacccctcactcctgtgacaactggttcctctcgaaccagaatagtctactaaatacaagaaatgattcccacatgctcccagggactgaatcctgtatcaggaatggttatcccaccaagaaaggtctggctccctcaaccagatgaggaaatacttccctgcactccacatggtctgccctcccaccaccgcacacggaccctctagctaatgaatttttccttgctctacccacactcacaatgagctctctctgctataaggaaggacccggcactctcagaacgttctttctccaccatataacgatgagccctcccacccgaatgtacaatgaactctacctccattaggagggagcccccagaacggtctcctccgcacataatgaaagacacccccatcctcaaaatggaccctctctagtcacataaagaaggactcgccccaccctaactcacaatagtctctgtccctttataaggaaggaaccaccaccctcagaatagtctcccccttcttcagtgaggaactcccacacccgcagaatggtctcttccacacggaaggactccacatattcagaatggtttcggtggccttagccttcccaaaaagaattacccaccacactcacaatggtctctactctccatatgcggaaggatcccacaatcactctcagaatgttctcttccccgcccccaacacactgacaatgtgcacacacacacacacacacacgtcggtccacacgggatgctccctctcactttagtgaggaacattcccgactcccagcgatcccgacctccgcctcccatgcgactgctcgggcagactgtctcacccgcactggcggtccccggctccaatgcacccgcggaaaccgcccctggcccgggcgccgcggtggaaccaccagccccaaccgctgccatgttg

SEQ ID NO: 2312 - DNA, 25344 bp, Homo sapiens
tttgagacagaatttcactcttgttgcccaggctggagtgcaatggcaagatcttggctcactgcaacctccaactcccaggatcaagcgattctcctgcctcagcctcccgagtagatggaattacaggcacgcgccactacgcccagctaatttttgtatttttagtagagatggggtttcaccatgttggccaggctggtcttgaactcctgacctcaagtgatctgcccgcctcggcctcccaaagtactgggattataggcaggagccaccgcacccagccaatgacatgaaaattgatcaaattgggaaggtagagacaacagttgaataaaaaacaggttaatctcatctaggttttaaaaagagagagaattctggaagggtatgaactaagaatttattttatttatttattttttgagatggagtttcactgttgcccaggctggagtgcagtggtgtgatctcggctcattgcaacctccacctcccaggttcaagcgattctcttgcctcaacctttcgagtagctgggactacaggcacgcaccaccacgcccggctaatttttgtattttagtagagatgaggttttgctatgttggccaggccagttctcaaactcctaacctcaagtgatctgcccgcctcagcctcccaaagtgctagggttacaggcatgagccaccgcgcccagccctgaactaagaatttataatggtgacgtctggatggtgaaaatattatttttttttgacatttaaggtttttttgtttttgttttttttttaaatagagtcggagttttaccacatttcccaggctggtcttaaactcctgagctcaagtgatccgcccaccttggcctcccaaagtgtaggattatagggatgagccaccacacccggccagacatttaaggttttaaaaaaatctttgctcatttgtggtttttaaaaaatgtactacaatgagcacatactatttgtggaacaataaaaaagttatttccaaaggaaagtggctggtaaggaggctgacatgacagccggcaataataattagtgatcattacaagttggaaaaagggaccttctccttggatggtgcacctactatgagccacataatttatggcaccagagaagggggaattagcccacagatgattaaacagaaagtcagagagagagaatgactggcctgtcctgcatgtcgcaatctgaatccaagttggtgggcttggggaaaagttgacaagaaaatatgtgtgctgcgcccaaagtaggagatgggtttaggtgaggagaaaaggggaggggttctcagatttttgggttgagagaagctggagctgtaggttcttcctttccccttaccctggctggaacagccgagctctccttttcccgcaagatctcccggtagctgaaggaggagatgctactgctgtcccctgtctgggtccggcttggtgagttcatctctgagagaaccagctcctcaaggcctgggtggtggagggaagagaaacttgagccccagtacccctgagtcccagggcagcaaccagcaggaagaggcagaaatagatttaacagagatggaaagagagacacctgggcatggggaaaggcagaagcagacaggaggacagggagagacagagacagaaaaaagagctgaggctgggcgcactggctcacacctgtaatcccagcactttgggaggctgaggtgggctgatcacttgacgtcaggagttcgagaacagcctggccaacatgaagaaaccccgtctctactaaaaatacaaaaattagccaggtgtggttgtgtgtgcctgtaattccagcgattcaggaggctgaggcaggagaatcgcttgaacccaagcaggcggaggttacagtgagccgaaatcgcaccattgcactccagcctgggtgacagagtgagactcttgtctcaaaaaaaaaaaaacaaaaaacagaaagaaaagaaagagctgcctttctggagaaacacatacaaaatgagagggagaaaatggaagaggttggagaaagagaacgacatgggtacacatgggtctcaagtggcagacacacttggacacagggttcagagaaaggaagacagctagagagggcacagggcacatccacttgcagaaagaaaatgccagagatggaaagccagagcagatgatagaaactgagaccctggtgaaagaagtgagccagagcagagacagagagaaaaaaagatgccgggcgcggtggctcacgcctgtaatcccagcactttgggaggccgaggcgggcagatcacgaggtcaggagatcgagaccatcctggctaaaacggtgaaaccccgtctctactaaaaatacaaaaaattaggtgggcgtggtggcgggtgcctgtagtcccagctacttgggaggctgaggcaggagaatggtgtgaacccgggaggcggaggttgcagtgagccgagatcgcgccactgcactccagcctgggcgacagagcgagactccgtctcaaaaaaaaaaaaaaaaaaaaaaaaaaaaaaaagatgcaagcaggctctcgtacccacgcacctaaatctcagtttaatctaatggacaaggtgaatgtattgaatgtatggtatacgattgtaacgtttcccaagattattattattattattttttagacagagtttcagtcttgtcgcccaggctggagtacaatggcgcaatctcggctcactgcaacccctgcctcctgggttcaggcaattctcctgactcagcctcccgaagtagctgggattacaggcgcccgccaccacacccagctaatttttttgtatttttagttgagacggggtttcaccgtgttggccaggctggtcttgaacccctgacctcaggtgatccacccaccttggcctcccaaagtgctgggattacacctttcccaagattcttacattcatctgtgataaaacagaaacaaaactcctttttaaagaaaggttacttcaggagaccgagtgcctcagagagaaattgatttggtgagagatacacatctgttttgccacatcacttaaagccctcgaggatctctggcaagggtggggtgactgagtggggatccgtaggtatcccgagtgggggaataagggaccaagttttctctgagtctgtaatctaagagatgcaccagagccatcactgcattttacttacttaaatgtatttataggccatccccgtcttaaaaaaggctgaagcaactaaagttgtgtgtgtgtgtgtgtgtgtgtgtgtgtgtgtgtgtcttctgcttgaagtggcagaaataacagattggattagctgtataatgaaaacaccacagcgttgctgactatgtataagtctgtctccgtagctcaactgggggcttctagagggcagagactcagggagttttatatcagggaccctgtacttgagcagggagatttatagaatgagagattgtatacaatagatttagaaatgccaagtgaggtgtgggagtgtgtaatgtagtacatacagtgaggagacagacagagatataaacagaagagacgaagaggacacagagtggcgggaagagataaagggacagagaaaagaaagggcgggggccgggcccagtggctcatgcctataatcccaacactttgggaggctgaggcgggcggatcacctgaggtcgggagttcgggaccagcctgaccaacatggagaaaccccgtctctactaaaaatacaaaattagctgggcgtggtggtgcatgcctgtaatcccagctactcaggaggctgaggcaggagaattgcttgaatccaggaggcagaggttgcggtgagccgagatcacaccattgcactccagcctgggcaacaagagcgaaactctgtctcaaaaaaaaaaaagagagagaaaaggagaaaactagagaaagaaagcaaggagataaaggcaaacatagaggaaagagagagaacaaactgagacagaggcagagacagaaacagagaagagacagggcaaaaacgagagaaagatagaaataaagagagaatgcagagaaagaatcagaggagagacagagaaaaggtaaaagatggagttccagagcgacagaagcaggaaagcacagctgaggaagaggcaggactaacctgcagcctgcaggcccaggccctacctcccccatgcctcagcctcctctccctgtcctagtccctcacctgagcggctcttgctgttagtgaggatgtcctgcagtcgctcctgcagcttatctgcccgtttccgctccaaatgcagctgccgcttgaggtccttgagctgtgggggacaggggtaacatgaggactgaggcccagtgggcccataggagggaggctacaggtaggagggagccgtgcttgggcaccgctctgtcttaccgcagcactgcccttcttctccaggatcctctgcccatccactgtgtccttcacctcctgtgggagaaagcaggcatggctggtagatgccggaagggctgcctgaagcatgctccctccctgcccctcctgtacgctgaggatcaggggtgtgtctggggctgtgcagtgaccactgacctgcttcaggctgctaatggtcttcaggtggcagtcccgctcctcctgggcctgctcgagctgatcccgtacatcctgtagctcctcctccttgccctgcaaagcagaaagcagcttaggcattggcttgggaagcctctgtcctcccaggagggcccgtcactgtctggagagaggaacaccatcatgcgagaggcaccttcagctcggcagcgtgctgctcccgacactgcttgagggcttcctcttgttcctgctgctgctgctgcagggattcctacaagacaagtcccaggtctggccacagccccccagaaggtatcatgcccagttaggggtatgagggactgcaatgggggcccagaggtatgcagaaatgaccctcctgcagggaaccccacacgcccttaggcaatatgctgaagtgtcacatctaaagttgcaccattcgcatggttgacttagatttgcatttacattttattttatttaacaaaacatagcgcttactacatgccaagaatgttctaagagttttacatatattaactcattttctataatcctcccgtaatacctagatggtagatattattgttaccccctttttaccattgatgaaaacaggccacagagaggtcagataacttgcccaaggtcacacagctaggaaatggcccagccaggattcaaacctagacaaacaactggctccagcctgtgctcttcactgctacatgacaatgcctttcagtgtattatgagatttccagaaaatggcaacaaaggttctttttccgagacagagtctcactccgtcacccaggctggagtacagtacacgatatcagctcactgcgacctctgcctcctgggttcaagtgattcttctgcctcagcctcctgagtagctggaattacaggcgccagccaccatgcccggctaatttttgtatttttagtagagacagggtttcaccatgttggccaggctggtcttgaactcctgacctcaagtgatccgcccacctcggccttccaaagtgctgagattacaggcgtgagccaccgcacccagcaggttcttgttcaataacatcagtgtattgcattaatttcctgacagaagtacagtttcaggagaaagaggtgcctttccaaatttgcacaaaggcagggcagccttaacacgtgacagtctgtcctatctgatggccatcccctgatccactccagagggctgctattgagccaggggactgtggggatatccctaagtccagaaaatctcgggaagttccagggcctgaccactcctgcttctgtggtttgacatgagggccccaatcagcctctgttcctcaccaggcatcaccaactcacctcggcttccttcaagcgccgttcaaaccagcccttggctccatccatggaatgtacctgagcttgaagttcttccactgtctgctggagagtctccagctcccgtgtccgggcctgggatggggcagactgtcatgggccaggaaggcagaggagcgggcacctgatgcatgccacccactggcctatcagcaacgctgtggttcccaggttttagaggaagaagggcatcatcatctacccacccaccttctcctcccggatctgcccacggagctcctcctcctgacgcttcttgtcttcatgcagctctcggagctcacgctcatagcgggcacgcacccccagcacctccttctcatgccgtagacgaactgctcccagctcttccttgtgctgggacttctcttgcagcgtttccattgctagctcatccagcatggccttccgcttctccgcactctgggggccaggacgatggcagtcaacttccttccacaacatcgaaaaaaggcctccaaccctcttcccatgcccaaggaactagccaaactccactccctcccatccccactgaactggctaaggcactcacccatccttatagaactggtcactttctttctttcccctcccactctcatggatttggccaagaaactggtcaaccagaaaccagtcaattttcctttccctcctatccccacatgtttggttatatcacctcctcccatccccatggactgagccaattcctaccccccatcctctcccttcaaccctcatgttcccctaccttccgagcctcctgtaattcctgggtcaactgctccttctcctgccctatttcttgaagttgttccagcagtcgactattggcccgtaatgactcctaatgcagacaccaaagggaaagagtttgataaagagcatccagtaggtgctagtcacccaggaccatctggtagaccatctcccttctccctggtaaagttggtattgtgatctcaatttctggataggaaatatagcagagactgctagttgctccccagtattcattcttccttacttccctagcaataaaatttatcatcgggcatacagctgtctagcagatgtttcccctcctcccttatggttaggtgtggccatgtgatttatttctgtatgtggaagtggtgagtgtaatttaggttatgctcttaaaggaaaggggcacactcttccctgcccctttcctccttccttccagatagaatacaaacatgatggtcggggagtttcagcaaccgtcttggatgccaagataaaagtcttgtgttgaaggtggaggaacagcaatggagaaagaacctgggtcacagatgactggaaagccatcattccatccctgaataacctacctggacttttaatgagagggaactaaatttgtatcttatttaatctactattattctggtttctattatggaatcagaatggatattgcttgggaggctgagccgggtagatctcctgaggtcaggagtttgagaagcctgaccaacatggtaaaaccccgtctctactaaaaatacaaaattagctgggcgtggtgccaggcgcctgtaatcccagctactccggaggctgaggcaggagaatcgcttgaacccaggaggcggaggttgcagtgagctgagatcgcgctactgcactccagcctgggcaacagagtgagactccatctcaaaaaaaaaaaaaaaaaaaaaaaaggaggccgggcgtggtggctcacgcctgtaataccagcacttcgggaggccgaggcgggcagatcacgaggtcaggagatcgaaaccatcctggttaacacggtgaaaccccgtctctactaaaaatacaaaaaattagccgggcatggtggcaggcgcctatagtcccagctactcgggaggctgaggcaggagaatggcgagaacacgggaggcggagcttgcagtgagccgagatcacgccactgcactccagactaggtgacagagcaagactccatctcaaaaaaaaattaaattaaattaaaatttaaaaaatgaaaaagaattgatatcctaactaactgaagaggctcagtttcagagaagtgaaatgacttgtcccagaacacacaggtgctaataagttagggagccagactggaacctaggtcctcctgactccagtcttcccactccaccttactggggacttcactgggccattactagggaactaggaagagacaggccagagccaaaggtgttacctggagctgggagttgaggtcatctttctgtcccataaggtcctcgtactcagcctgctgctgctgcaactcagctgccagcccagtggtctgttcccggagcatattcagttcttgggtctttgctgtttggatctggagaaagtagtggtgatgagaagtagagtgaaagggaccccaggggccagggacagggtatgagccccctagttccagggaaacagggagggaggtgggaagagaaccaggaagagagaggaaatttcaaacagaaaaacaatgaagagaatgggtaaatgtggtatgttcatacaatggaataccacacaacagtaagagaacagatctgtgctgccacgtggataaacttacatagtgctgccagaaagaagtcagagacaaagagcagctgattccatttatatgaagttaaagaacaagcgaaatgaatcttatgttgctagagatcagaataatggttacttctgggggagtactgactttgaaggggtaaaggggaccttctggggtactaaaagtgctttatactttgatctgggtggtggctatggtggcggggagagagagagaaaaaaaagagagagacgaagagaggattcactgagtgtacacttaagattagtacatttcatgcactttactagagagaaactagaaacaaagaaaagcagaagccgggcgcggtggctcatgcctgtaatcccagcactctgggaggccgaggcgggtggatcatgaggtcaggagttcgagaccagcctggccaagatggtgaaaccccgtctctactaaaaatacaaaaattagctgggcatggtggcacacggctgtagtcccagctatttgggagggctgaggcaggagaatcgcttgaacctgggaggcggaggttgcagtgagccgagatcgtgccatagcactccagcctggacaacaagaccgaaactccgtctacaaaaaaaaaaaaaaagcagagataggccaagcacagtggctcacacctataatcccagcactttggaaggccgaggtgggaagatagcttgaggccagaagtttaagccagtctgggtaacatagtgagaccctgtctctacaaaataattttgttttctcttttttgagatggagtcttactctgtcacccaggctggggtgcagtggcacaatctcggctcactataacctccacctcccaggttcaagcaattctcctgcctcagcctcccgagtagctgggattacaggtgtgcgccaccatgcccagctatttttttttgtatttttagtagagacggggtttcaccatattggccaggctggtctcgaactccgaaccccaggtgatccgcccgtctcagccttccaaagtgctgggattataggcgtgagccactgcgcctggcctaatttttgtatttttagtagagacaaggttttgccatgttggctaggctggtctcaaactcctgatgtcaggtgatccgcccacctctgcctcccaaagtgctgggattacaggtgtgagccatcatgcccggccaataagttttttttcgttttgttttttgtttttttgagacagagtttcactcttgttgcccaggcttgagtgcaatggcacgatctcggctcaccgcaccctccacctcctgggctcaagcaattctcccacctcagcctcccgagtagcttggattacaggtgcccaccaccacacccagctaattttgtatttttagtagagacggggtttctctatgttggtcaggctggtctcgaactcctgacctcaggtgatccgccctcctcggcctcccaaagtgctaggattacagaattgagccaccatgcccggctttttttttttttttttttttagacggagtctcgctctgttgcccaggctggagtgcaatggcacgatctcggcttactgcaacctccgcctcctgggttcaagagattctcctgtctcagcctcccgagtagctgggattacaggcacacaccgccacacccagctaattttttgtattttagtagagatggggtttcaccgtgttgcccaggctggtcttgaactgagctcaggccatccacacatctttggcctcccaaagtgctaggattacaggcatgagccaccacgcccttttttttttttttttttttttgagacagagtattgctctgtcgcccaggctggagtacagtggtgcgatctcggctcactgaaacctctgcctcctgggtcctggttcaagcaattctcctgcctcagcctccccaataaaatttttaaaagttaaaaaaaaaaaaaagtagggatggatggccagagagaagagggctggacgccaacagaaaggagcaacagaaacaaagacaggagaacagcatggggtccagaccaccctaccctgatgtggaccagaagcagatggagatgggggaactggagagggatcagcaagggcccccaggtgttctttacctgctccagggcagccaggctagtcctcaaggcattgttctcagccaaaagcccttccacttgttcctgtgcatctgcactctggatggatacctggccccacgtccacagcaggtgagagtgggtccagaacagggggacaggacctacccacgaccaagaaagaaaggacacacacacacacacacacacacacacacacacacacacacacacacacacacgaaggcctgggggaagcaggatccctgggaccttgcctgactatgtagtacccactcaggctgcccccatcctgaaccccagctccctgagcccacgcagtacaatatacctgatcttgtagggcccgcaaagctgctgcatgttccaggcgctccccctgccgctgatctctcagctctgccaagctctgtggagaccaggggagcccattttacacctcagcctctcctggggtgcatataaccgtacagactctctgtttgaccacccagcagcatgttctcagcacctgtgggtctcagactatccagccaacagcaatctcaggttcacccagacgccaggtcactaccctcaggggcctcagacacagtcaacccctctatcccagcgtacaagatctcaggcacgactagactcctggccctagctgctacgcggttcaaactcactcagctcccatccataagaagtctcatactcacccagattctagcttgggagctccaggattctcagacacagtcagccccatggatctcagatgtagtcagcacccaaggatgacagtttcacccagcctcccaatcccaaccaccaggggtttcagacacactcatctcccacgtccctacttcccaggtgagatccacccaaactcatagtcccagatcctagaggtctcaaactcacaacctcctagtttccaggtcctggtgaactctcagactgaccccttcacctgtcactctgctccccagtctcttggaatcttcagacccagttaaccaccagttcctgggggtctcagctttacccagactcccgtctcagaccccatgttcccagtttctagggacttcagaaccacaagccaccatatcctccattccaagggacctcagactcaccttttctagaaggaaacccagaggcttcagaaccatccagcccccagtcctcaggagcctcagacccacctaaacttctgctccagcccctggaggtctcagactgaccagctttttgttcacagccctcaaggatctcaggactacctagcccatatgatcccacttcctaggtgtcttaggcccaagccagcgcccagatcctgaggatctcaaatgcactcagccttcagccccaactatctcacccttgaaagttgtatatctacccagccatgtcctcagcccttgggagtcccaaatttactgacatcccagcccctaaagatttcaaagtcacccagcacccagggagttcagacttaccccagttcctggtcctaggccctagtgaccacagattcatccagactgtggtctcaaacctccaggagtttcagatttacacaaacttatagcacacagccccctaagtccttagccccctgagatcttacactcatgaagactcctataacaattcctagggctctccaattcccattttcctagctcctggggggccccagaacccatttccaacacaggaaatctcagactccccagccagcctccatggacctcagacctctccaggctcccagtcctggcccctaccccagggatctcagaacccagtccccatcacctgattggcagcctcaagttcctgctgcagcttctgggttcgagccaactgggctttgtgatcagcttccttccgttgttgtaattcctcaatcttgttcctaggagtgatggggagggggtgtgttggacatggcttgaggcccagtctcctagctctgcccctgtaatcttcactgggcactgtcccaattgtccaccaatacccgcaaatctggcagttacctgctgtcattaaacagagtctccttttctgtctgcagacggcaaaaactgggcacagaaggacagatgtagatgggtcagttccgtaagttaattcccccctcggcccccagtacccttgggaaaaagaaatttacctttcttgtttctttttcagtttctcggagagctggggagagaggtacagacaagtgataacattgagaataatataaagacaaacctaaaattaataaatatagacacttcttattaagtcatttttggaagccaggatttacttatgttgtcttgtggaatcctcaaaatagccctgacaagtgagtagtaccagttttacaaatggggaaacagagtcttggaaaggttaagtaatttggttgctcagcgggtcagcaacaacaatattatctccacccagatccttcaggttccaaagcccggtatttatgctcccaacatagtggccaatggccatgttatagattggctaggctgggaggcctggaaagcaggatatcatgactgggtgccgcacccctgggtctccaggtcctaagataagagccaggagtctgtaaatgcttgcatgaatgaatgaatgagtgaatgggcaaagctgagagatggatgggatgaaacttatcatgcacaagatatagtgggaccacattaactcattccatactgaaagtaactctgagacataggtgtgagtctctccatttcacagatgatgaaacctaggctttgatggggtacaatgccccttctgccctaggattgggaatggaatgggaaagaatccagcagattgggagcagaatgggaaagagccaagcagccgcaccttagcaagttcctcctgcagcctggatgtttcggcctgctttgagctctgcagggaaggatgagggatgggagggttgttgttagcaaggacaaggagaagccttcccctgccctcctgcctccctcaccccatcagcccacaagatggtgatgtcacagccatctccgtgggactatagacagaggtagaacatctgccctgccttctggcattccagctccaacagactcagattcacctctaagccttgcagctgttcccagagcaatctcttctcctctttctccatttcccatttcagctccacctctgccaacggcatgggggccaggacggtgggggccgggccccctgggggatccccctggccctcactgacagctgagaacttcccggcttctttcccatagcgttcctgcagggctggtgagtagaacagggatatatgatggatgaggtggtctctgaagtcccttgccatgcctcgaatagagggagaactggccttcaacccctcaggtggcagagtccctgtgccaaatgaccacatgcctaaaagacgaaggttcagctctatccatgcctctcacatttttttctttttttttttgagacagggacttgctctgtcacccaggctggagtgcactggaatgatcacagttcactgcaaccttgacctcctgggctcaagtgattctcccacctcactctcccaagtagctgggatcagaggtgtgtgccatcatgccgggctaattttttgatttttttgtagagacaaggtctcgctacattgcccagactggtcttgaactcctgagctcaagcaatcctcccacctcagcctcccccaaaaatctttttccgtggctgggcacggtggctcacgcctgtatcccagcactttgggaggccaaggcaggtggatcatgaggtcaggagttcaagaccagcctgaccaatatggtgaaaccccgtctctactaaaaatacaaaaattagctgggcgtggtggcgcacgcgcttgtaatcccagctactcgtggggctgaggcaggagaatcgcttgaacccaggaggcagaggttgcagtgagccgcgatcgagccattgcactccagcctgggtgacagagtgagactccgtctcaaaaaaatctttttccctagacagtcttgctctgttgcccaggctggtgtgcagtggtgcaatcatagctcactgcaacctcaaactcctgggctcaagcgatcctcccaagtagctgggactacaagtgcacaccatgcccagttaattttattttattatttatttatttgtttattttcttgagactgagtctttctctgtcacccaggctggagtacagtggtgtgatctcggctcactgcaacctctgcctcccaggttcaagtgattctcctgcctcagcctcccaagtagctggaattacaggcatttgccatcaaacctggctaattattgtatttttaatagaaatggggttttgccatgttggccaggctggtcttgaactcctgacctcaggcgatctgcccaccttggcctcccaaagtgctaggattacaggtgtgaaacaccgtgcctggcctaattattttatttttagtacacacaagttcctgctatgttgcctaggctggtcttaaactcctagcctcaagagatccttctgcctcagcctcccagagtgctggaatcaaggtatgagccactgtgcccaggctctcacaaatattttaagccctatcaaccactaagattctgtttactattaaattagcccaagctggtttcacaaatcccattctcaatccttgaagccccacccatagcccttgaaggccatgcccaccatatgctaccactgacttacagctgaatccctcctagagcctcctaattcctactcacattctactaagtctccctcctggtcatggaaccagcatccatcaccacagaagtcccagctgctctccaaagttccacacaccacatgctcccacactctatcaagctttctttcagctttcatcccagaccccacttacaatctgggctcagaatcttcccaacactccattcactttttcacttagcaaatatctcctttttttttttgagatggagtctcgctctgtcacccaggctggagtgcagtggtgtgatctcggctcactgcaagctccacctcccaggttcacaccattctcctgcctcagcctccagagtagctgggactacaggcgcccgccaccgtgcccggccaattttctgtatttctagtagagacggggtttcaccatgttagccaggatggtcttgatctgctgacctcgcaatccgcccgcctcagcctcccaaagtgctgggattacaggcgtgagccaccgcgcccggccgcaaatatctcctttttgacattcaagctgctaatctgtaacatctgctaggtaccagacactgaactaatgcagaatgatatcaccttttatctctactacaatcttctgggtgacagacatcactacatgcactgtgtagatgataaggctttggctcagagaggtgaaatggcttgtccaaagccacacagggcatgggccaaccctatttctgaagcccttctccttcccctgagaggatgacggccttccttgccctactcaagccccaatgtctccgcatccccaggagggcctctatgcacctgccacgttcttctgcaaggctgtgttttcagcctgtagcctcagcagctccccatccacgaggggcccagcttgggcaacccctgctcctgcagccccctccttcagttgctggttctcttgctccagctgttccatctggctgcagagctgaacagaggaagagaaggggcagagaagcagagaatcagagcagtatttgctgaaacctacatagcatttgtccatgtactttacaattcacttaattcccataatgaccctatgatataggtgccctcccactttacaaataaggacattgaggcacagagatgttaaacaagttcaaattcacacatcttttaagtggcagagtcagagaataccaagagcataccaagtatgaggacaccaaaaaccattttcctcttcctactcccaacctcagagatgcaatccaagacctcaggctcctctggaagttgttagtgctacagacagcctcactgcaacccctcttctgtggagggctggatcctgggcccagagatagctccctctcatcctaagcaccacaaagagctcgcagggcatttccagggccaacactgatgacagctcctgcattgccagccgttagtcttggagaggtatacaatgccaatacaactaagccagccccctgcccaactcctggctgaagtacacttctcaaagcagtcctgagaaaattccttgtccccattttcagatgagaatatcgaggcctacagagaatttttattttattgcctgcaatattttctttctttcttttttttttttttttttgagatggagtctcgctctgtcacccagcctggagtacagtggcacgatttcagcccactgcaacctccgccacccgggttcaagtgattctcctgcctcagcctcctgagtagctgggactacaggcatgcgccaccgtgcccggctaatttttgtattcttattagagacggggtttcgccatgttggccaggctggtcttgaactcctgacctcaggtgatccacctgcctcggcctcccaaagtgctgggattacaggcatgagccaccgcacccggcctgcttgcaatattttctacccagaacaccaatcctctcatccagttcttcacctaactggcttctttgcatccctcagtgctctgctcagatgttgcctttaaagtagtatccctcaacacagaaaattccagtactctctgtcacagcactgttcatttctttcttacctagtactaatcaaaattttcttttgtaacaagcacagattctgaaaccagactgcttgaatgtgaatttctgctctgccatttactagctgtgtgacaaattacttaatctccctggaactcagttttcctcatctgtcagatagggatactaatatctcacaggcttatttcaaagattaaatgagtgaataatgtagagtacttcaaacaggacttggcacacagtaagcaccatataaatgtcagctatcactactagtattatttgtttactgttatcatctttctcctcatcccacccccagaatgtaagctacccaagagtggagatcattctgtgctgcttacaactgtatttccagaacatagagcatgtggtgggtactcagtaactatttgtcgaaggaacaattaagctgaaatgtcttgatgaataaggggtggtggcaggtttaacgtagctctctctgagagcacttccagttcctgggaggagttggaggaggaaggggactatgtaggaagtctctacgactagcccagtgctggcccagggcagatgcagggaaacaagctggatttatggaagaatgtctgcccctgcctcactctgcaagaatcatgataccatggaggctggaggcaggaagcagtgaggagtcagtcagtgaagccagcagttatgtgaataccaggggctctgaactaggagcaggactggggcactggaatgtattaagtaaaggagtgatgtcataagatctgcaggtcagaacagcctctgtggtgtgaactaagtagaagaaactagaagtgaagagaccagggaggcggctgtagaaacagcagatgataagtggtagaggctaaggcaaagcagggccacagggtggatataaaactttttttttttaaattgagacagagtcttgctctgtcgcccaggctggagtgcagtggtgcaatcttggctcactacaacctccgcctcccgggttcaagcgattctcctgcctcagcctcccgagtagctgggactacaggcacgtgccaccacacccggctaattttttgtatttttagtagagacggggttttaccacgttagccaggatggtctccatctcctgacctcatgatctgcctgccttggcctcccaaagtgctgggattacaggcctgagccaccacgcccggccataaaacttttaaaaagtcaaatattttagagggaagatgagttaatagaaggataatattataactaatgcttccatagctgatactatgtgcaaggctctgttttaagtgatttacgtacatttattcatttaatcctcacaaaagccctgtgaagaggcaggtactgttattatcatgacttccattttaaacatttgggaaccaagaaccaggcaagttaagtaacttcctcaaggttacagttagtaaaaggtagagccaagattttaatctaggccttctggttccagagtccctgctggtacctactacttgctcaactgcctctcctggtattgtacctgcttaaaggttattttcggttttgtttttttaaggtcataggcactatattctcagatggagccttagaaataccatttttgggccgggcgcggtggctcacgcctttaatcccaacactttgggaggccaagacgggtggatcacctgaagtcgggagttcaggaccagcctgaccaacatggtcattttctctactaaatgtcctctcccacccatgtcattttctctcatctctactaaaaatacaaagttagccaggcatggtggcatatgcctgtacttccagctacttgggaggctgaggcaggagaatcgcttgaacccaggaggcagaggttgcagtgagctgagatcatgccattgcactccagcctggacaatgagagtgaaactccatctcaaaaaaatttgctgccatgagacttttttccttaaaacacactaaaaacatagacaattatcaactgtggatacagaagatagatgagggaacaaaagacaatgtctccaactgcccagtagatttagaaacagacaggacactaaaatcaatggggagatagaattagtagctccaggatgaattatctggaagaggtagaaccccaggctcatgtcagatgaagagaagaaagagaaaagggaagaagctcgaacacttttccatcctatattaagcataagaactctgcctaaaaccccccaacaccttggagcaccacagcatcaaccccacattatacacatggagacttgaagctcaaataaaaggagtgacttggccaggaaccaggtgacctcagggctcaaagccttctaatcccagcagagtgagcggccccatctgtcaaattactgccccccagcagcaatccaggacctgtttcagcaccacggacagtgctccagggccagaccctgtccaatcactctctgccgctgttaggtttcagcccagatgacccctacccctcatttcccctttgactatcccaggcaccagcaccttgctgaactcggccattagtgtgctgttctgcaaacggaagtcctcctcctggctgtgcagctttgcctgcagcatctcattttcactcagcaatacctcgacttcctgcagtggcagacaagggccaggactccagcaagggcaaaaaggatagggaggtagggcaaagaaacagagagagggagaaaatgacatgggtgggagaggacatagggtacagagaatgaggtgatataggagaaagagacatggggagggataaaatgagagacagggaaaggaagataaagacatgggaaggtagagagaagggaatacagggaggaagagagcggaggaaaagacaggaagataatgattggggagagaggaagtagagatggggaaagggggagagatagaaaaggggagagggattgggagggagagagtgaaaaagacggagagaagaacaaacagaaatcaacagggagagaacagaacagggagaagaggaggggtcaggaaaagaaatgagttaggaagagagaggaatggggtggaagaaacaaggagttagagagagaaagcagaaaaaagagaaatcaccgagacaggaacaggagggggagagacaaagagaagattgggaagagaaatgagtcagagagacaggaacaggaaaacagacagagacagaaagagactcagagaaaagaatggaaagagagagaaggaaagagacacagagttaggacaaatacagggaaacaaggacagatacagcaacacatggcagtgaggtagtagcagatgtaaaggcacacaaagaaagaaaggccagtacaaggaaatatcagcatacagaaatagcccaccaagacatctcccagtcacactcacccacaagggatccccttacctgagctttcttgctcttgctcagtgcctaaagtgggggtgggtgggaagagagctaaagtgaacagagatggactgccttactaggatatggagacaattgtgccaagcgttttgggaggacaaggatgacaggggttgcaggatgggagcatcttcaaccacagaacatgtgtgacaatttggagcccaaaggaatgatggaatgagtgtgtgagtgagtgaatgaatgcaagtcttgccctggggccccagcacacataaatcatcctttcttggaagctcttgaggctggtggggggacaggggaggtagggagatgccctggtatttaaccatttatgggctggatctccagactcagaaactgtggcttcattgctacatctgtccatacatgtctctgtgggtccctcccacgcagtgtggaaactgtcgctcccctactgggcagccaagagcattgccagcttaggggaatcagcatcctaccaaagagaagtgcagcttcctgactgtcggattttctgcatactgtattcgttcatccaacaaatatttattgagcacatattatgtattaacattgtgctaggtatggctagatatggggacagagcagtgacaaaggagcacctcgaatgtcttgaggggccacaataggttatatcctatctcatctttagaggatctgagaggtgggtttgctctcattttcccaactggaccaggacagagatgggaagtaggagcacaaggcaggagtgtgagtagaggatgggaggcagattcgaggtagatttactgatagatttgaatatttaattaaaagtcagtgaatgagaatgagtaactgaaattagaaatgaattaaaagtaaattaaaattaatcactaaattaagcaggattaggtaaaattagcaactaaagagaattccattgagaatcctttaaatgactacgtgaaaacagcatgcaacattaggtctggttcactgtaggtgctcactggagggatgaatgagtcagataggtagaagcaagggtggatgggtaggtggatgggtgggtggagggaggtaccttctgagctttgctgaactccttatccaagtaggcgaccttctgtcgaagactggtgagttctggtgtcgggaaagcagggaaactcagcctcagccagtggcaagaaactgaaaggccttcctgccaggcctctgagggaaaacctcggacaccattccccaaagccacccccatctaataaggccctcctggctcaccaacaccattcttgcgtagttcatctgaaagctggtagttgtttgtccggagttccaggagctgagcctttgggggaggcaggaagggaaaagacttggtcaggaaagcgcccctacccctaccatgagggaaccaagcccctaagctccacagaccttacgccctccatgtgcctctgtagctactccttaagacctgtatgtgctacacccaaagtgaccttccaggccctcagaccctggctcaccttttccagctccacttataaccccagccagcctcacccctccatctcacactacaatccacgctgcactcaggccatcccagagcactgcccccagtcagggtcttgcttgtgtgagttccctggctctccatgcccacaggataaagttcctcctcctcatcctggctgacctctccacacactgaacacacactgtcaggggtgttgtccatatttctgaccagacctgggggcctctgatggcagggggttaagggcctgtcttcctccctctttcctaagggaaaagggtcaagtattctgcccaactttcattgagtcagggggctttccagggtccccccacctccaaggctctcaaaatacatccaggcccccttcaataattaagggaggaccaggtgcggtggctcacacctgtcatcccagcactttgggaggccaaggcgggtgggtcacgaggtaaggaattcaaaatcagcctgcccaatatggtgaaaccccgtctccactaaaaatataaaaaattagccgggtgtggtggcgcacacctgtagtcccagctactcgggaggctgaggcaggagaatcgcttgaacctgggaggtggaggttgcagtgagccgagattgtgccactgcactccagcctgggtgacagagtgagactctgtctcaaaaaaaaaaaaaaaaaaaaaaaaaaaaagaattaagggaaagtgccaggcgcagtggctgacacctgtaatccaaacactttcggaggccaaagtgggcagatcacttgaggtcaggagttcaagaccagcctggccaacatggtgaaacctcatctctactaaaaatacaaaaattagctgggcgtggtggtacgcacctgtaatcccagctactagggaagctgagataggagaatcacttgaacccgggaggtggaggttgcagtgagctgagatcgtgccactgcacactatagcctgggtgacagagaaagactctgtctcaaaaaaaaagaaaaagaaaaagaattaagcatcctcctccctaccagccctataggaccctgaggctggttctacccagcaaggccggttccttcccattaaggaacttactgttccttcccctaccaggacttttccctccctcccacgccaccagcctccactcactgttctctggtagtctgctcaaggtcagagggcttggccttcacagaatctttcctactcctgtcctctccaggacccagtgatctgtctctccaagtactggtccaagtggaatatcctttgtaccccccgagacttgccccccaacaaagcccagtagttctccctcattcatggcccagtgggatcaatgttcctcattcaagggtattcccactcccctcaagatctccccagtcatgatccattgggaatggccctacacccttcagggtaggcctctacaaggccttgggtaggccagttggatgactcttactcacttagaatccctttcagatgacagtggtcttccccattcatgggttaatcaactcgcccttccattctcagtgtccctcacacagggacagctggtttccctcattcaaggaccaattggattacctgtcctccctcagagttcctcccctccccatgcaggaccctgttcagaccccccccccagtgaggaaccctctcaacaagggcccattcatagtgcaatgctatggcctttcattgcatctcagagtccccccaaaagaatcaagtgggggtacctccccaaagcccagtgatcttccctccttgtagtccaaggtatcaatcttttacccctctggtcctccccccagttaatgggattaatggtattacccattcatggccttcttcaccccaggcctaatgggatcacccttaatcatccaatggtgccgccccctcttaggatgcactaccaaccaccaatggcacaggatctccacctcccaggaacaatgacaacatctggggtctttccccaatccccgggcacagtggtatctcccccaaaacttaccacctcccacccgctaatggttctgccctctcaagggctcccaccaccatgacgcaaacgacccaacacccgcttccttcctctccagacaaaatggtttcgccttctcaggatctccttccctcaaagcccattatcatcacccgccgacggtgtcccctgcacgggcccaaaagtctcgtcccctccaggtctgagtaaggtaccgcctacttaatggcgctctcccagcccacaatgctaacagagtccaaccttcaaagccgcagagtatctcggaatccaatagtctcaccactccgagcctcagtttcccttctccagacccaccccataaactcagggtccatcccaaccaaccccttctcagagctgatagcacgacctctcgctaccccgcccccggtcgcctagccgggtggtctttcccaccgcgagcggcacctgcatccgctgaaactcctcctcagacagagcttgcgccatgttcctccccccacccccccgccagctttctgcgc

SEQ ID NO: 2313 - DNA, 8045 bp, Homo sapiens
ctaaataaatacaacatctttatttggcattggatatcctgacatttgttcattacagttccttaaaaaacaaaccaaaaaatcagaacaaattaatcaaaaataaagatccaatggctctatttacatatagcaaagacagcccaggcatcttccatgcacacacacaccccgccccgatacagttaaggggttaataagctttggggagcgcaggaggcaggttccacagttcatcaatcccaagacacccccatgaggtaggggtgcctcacacagccagacggatatcaagagtatgattggtagctttttcctctcctagacatctccaaaaataagcctacatctggcaactgacagtgtcttaaatacaatgagattcagccacttcaaggacctccatttttcccacaccctggatcattaatgatatgattacaccacaaatcccaagtccactaaaaaaaacaaatggcccctaccacaccttctgccagaagggctgatgcaaaaatcttagctcttgtccctttctccctggggactcacaagaagcccatcttcaaggtatcaaggaagctggcccaaggccacacaaaagacggaactagtaacatgatccagagcggtggtaagggaggagagaaggcctcaaactatgggcaactgaaccccacaggtaggcatcggtcattcctgaagagctgcgggagttttgtccagtgtgtccttatggaggtggagggactgctgggagggactctcccagacgagaaacctccagaagagggcacagggtcggggagggagcagacaaaaaaaaggccttgaatgacaatacccccaaccctgcctccaaagaggttagagggagcagaggcggcagctctaaaaccccctccaggggaagggggtcaccctaccaggaagggttcacgtgacacccagctctagtcccacacccctccagaagtctcagtgacctgggagaaaagaccatctcccaaacccagaggagccaggccccggagggtggcgacttgggtcctgcagatgcccaacaccctccaccccagtccccctcccttgtgtccccccattgctgccagccctcacttcaccagcactgactttggcagaaagggctccgtgatgaggtctccacggtgggaagacagctgcggtggtggtggctgcccgggaggctgctggtgaacgcagggcccggaggcggaggcagaggcagaggctatggctttggctgcacctcggggaaggctgtagaggtagacagcaccaatgacgagtccagcgccaagggcaaataatgggtccacgtggaagccaaagaggcgaatggaggcaacagtggacagcacaatggacagggaggtggcaaagcccttgaggatattgtcagcgtacttgacaaccacagccaccagtagcccgccgaaggcctggttgagcaccacgccccagacagcaggtgtgtacccaaaaaagaaaccacgggtggccacggcggtaccctcagcccaccagagccccaccaggcccagtgctgtgccgaagaggcccagttgcaggttgcgcagccacacggagcctgagctgcctttgaggatcttctcaaagtagacacctgcgaagccggaggagagacaggaggccacgacggctgccaggcctgccccagggttctgatccagtggccgtgggcctcccccaccggcttgctgtgcctggacaatggcgacgccagtgaagaggagcagcagggaggcccactgcagccgggaaaggctgcgattcagcatgagcacggagaacagcgctgtggtcaggatcttcagctggtatgtcacctgcgagtggcacgtggaaggcactgagggctgaccctggcccccaacaggtgcacatggggggcagcacccactgtgggcccccaggcacaatggagggacagggtggggggtatgacagcaaaaacagcaaaaggagccagccactggccattggctgagctgcagcaaaacagttctgaagtctctcccagcaagtgcacaaaaggatggctgtgccaagaagtccacatcccaatcccatttcctggctgtgtgactggggacaaagcacttgccctgtctgagccctggcatcatcatctataaaagatggctgaggtatggaagtatctttgtgatgagggacttgatacaaatgaatcaatagccacaacaatgtcagcaaatacttacatagtgcttacaatatatcagtgtggttctaggcactgcacgtgaattcattcatttaattctcacaacaccattctgaagtgagcaccactgtaagccccaatttaaaggtgagaaaactaaggcacagagaggttaggtgacgtgccccaaaatcacacagctggaaggtagcagagctgagatttgaacccagacagcctggccccagaatccaggctctttaaccatttcacaaagctgcccacaaatagcctaaagcttatctgtcaccaatcaagggctcttcacaggtattatttcttttaagtatcctagcatctcaatgaacaggcattactatttccacccccaattttcacagacgagaaaagggaggttgaaggagttccaaggacattctgaaggtgacatagcccctgtcctctgcaacacccccccaccacgctattcccatactccagtccccaacccagttagttcctctggggccatgctgggcttggggctcacctggaaagtggcagctggtaggttagagatggcaacatactggaggttattctgcaaggtgtagatgagagagggcactgcgagcttgagcgtgtccacatactgcaccaggacagcctcatggaggaagagaaccaggtgcttcacgttacctaggtgggaggaggagagcccttcttagcactgacagccatacatggggaacccctgaaggctgggaacaggccttgctcctgtgactcccccatccaccctgctgtccaatccctggaggctggaatgaagtatgtgatcttggttttccctagagtacaaccatgtttccagcaagcttttctgagactcagtttaatggcagcaaaagaatcagccatccgtgtctgctaatcacagagcatgtcactcatgttagagcctacctccctggcagagagccccattcagggaaagcactcaatactcaatatatttgtgtacaatgaaataaccagcattaggccaggtgccgtggctcacgcctgtaatcccagcactttgggaggccaaggcaggtggctcatgaggttaggagttcaagaccagctgggccaacaacactgaaaccctatctctactaaaaatacaaaaattagccaggtgtggtggcaagcgactgtaatcccagctacttgggaggctgaggcaggagaattgcttgaacctgggaggtggaggttgcagtgagctgagaccatgccattgcactccagcctgggcaacagagtgagactccatctcaaaaaaaaaaaaaaagaaagaaagaaataaccatcattaacttggagcttatgaaatagaagccctaggagctggggtggagggctgtctcccacacagaagagtttagtctagactttttttttttttggcacagtggcgcgatctcggctcactgcaagctccacctcccaggttcaagccattctcctgcctcagcctcccaagtagcttggactacaggcgcgtgccaccactcccagctaattttttgtatctttagtagagatggggcttcaccgtgttagccacgatggtcttgatctcctgacctcgtgatccgcctacctcggcctcccaaagttctgggattacaggtgtaagccaccacaccaggcatagtctagacttttagacttatcctagctcctcactgacccatgtgccgtctgagggcaggggccatctcccccttgttgcatctttctgtcagccctagacacagagttgcctctgccacatggatgaatgcaggcttgaccattaagcagaagtccgcttgggacctgctccagtgaaaacatgataatcgggctgggcgcagtggctcacgcctgtaatcccaacactttgggaggttaaggtgggtggatcacctgaggtcaggagttcgagaccaggctggccaacgtggtgaaaccccgtctctactaaaaatacaaaaattagccgggtgtggtggcaggcgcctataatcccagctactcaggaggctgaggcaggagaatcttttgaacccgggaggcggaggttgcagtgagccaagatcgtgccattgcactccagctcagacaacaagggcaaaactccatttcaaaacaaacaaacaaaaaacatgagaatcatttcctatgtaacaaggcctttgcaaagctcgccccactttttggcagttcatctttttttttggcggggcggggtgggtgggtgaggagtcttgctctgtcgcccaggctggagtgcagtggtgtgatcttggctcactgcaacctctgcctcccgggttcaagcaattctcctgcctcagcctccctagtagctgggattacaggcacctgccaccgcgcctggataatttttgtatttttagtagagacggggtttcaccatcttggccaggctggtctctaactcctgaccttgtgatccacctgcctctcggcctcccaaagtgctgggattacagacgtgagcaaccacgcccagccagcagttcatcttttaagtcacagctgggtgtcactccacaggcaaaacttcttcaaacactgaacaaggttgtcccaggaactcctactgatgttcattcaccaaaccctgtgcactcctggtctccaaactcgaattcaggggaaaaaaattccgggcaggggagagaggggtgctgaaattgtggctaagagatgaaggcctgtgattaagtctgtggctatctgttatttccatcttccatcagcaatgaggacaagctgctcctctgcattgctaacccatctacccccacggcctgaggcagtgttcacacctacactgttcacagagttaacaaaggtaagagcaggtctcttgttaacctggagttaacaggtgggtgagaatattctcttcaatgtaaacaaagggcaaaggtgcataattcatctccatccctttacttatgcaagacctttttagagaaacaattgggcaacacttcaaagtagaaggccttcagggagatgttgaaattagcagataaacccaacttccaatttacaagagatgtagaagacagaatacttgttaaatttttgagaatatttgccttagggaggcagtcagcaaaatccagactacccaaagtctacaaaacaaatgacctgttttctccaacaaattaattgcaaagaccaaaaaacccctagagattaacagatttagaagataccaaacaaggccagcctggtggctcacgcctgtaatcccagcactttgggaggctgaggtgggcggatcacgaggtcaggagttcgagaccatcctggctaacatggtgaaaccccttctctactaaaaatacaaaaaaattagctgggcgtggtggcacgtgcctgtaatcccagctacatttattcaagataattcaggggaatttacttccatacaatattacttcgtgtgggatttacttaaaaataataagaggataaggacgtaggtagacatatagattggcagtgagtgaacaatcactgatgttgtttaaagcggccatgagttgctaattgctgactctgggggatgggtacatggatattttactatttgattattctctctgattttgcatgtattcggaattctccataatatgaagctaaatcacatgtgagagatccctgctactttataagcattggcaatctcactcctacagcccacacaggccggctacccggctgttagggctagaaaagtgtaagatgccgctacgcatagctggagtggcgctccaggcaggttgagatttggagacactcctgaagcaaaccatctgtgtgaacacacacacatacatgtggagtctcacccaccgaccccagtgcagccccatccctggttcgtacccctcttctgtgcgaagagcagcagcaggcaggtgagacctttgagcacttccgccatgaccacagcagtggtggcaaagaagcggtcccctggcaacgtgcgggcgtagcggatgctgaggatgagggaggcattctggaccaccagcacagctagggatatgtacttcaggcgcctgtgagctgtggggaacggaaggggcaagggggaaggacggggtcagaagccgctggggcatagccacaccaccacccaccccctttctttctcacccaggaccctcctagccatggctacttgctccctcagcctgcctgccctcacccaataagggtctgactcctaccggcttactgcctcagccatgagcaggaagagccagaagggagaaatgggccccaccctgtcccagtccatacctggaatccttactgaggtgtcaggtaatggctgaggcaaaccctggccacgcgcctcggcttcctcccaagtgagaagcaactcttccccagaaagaataccgacaactacattctccacgtttattgagtgtttactgtatgcctatcactgggttaagggatttctatggattacctcaatagactcatatcactgtcatctccaaaagaactgcgaggattcccatttatggattagcaaactgagaatttatatgaaatgatgctcctgtttaatgagggactgtctcatgtaaagaataacacatcaatgcagggaatgaggccactgtatgaggtatgttcaccccctaagaacggtctttctcctatctaagaaatgattcgattccctcacactgagaatggcctacatcccatatggaatgatcctcctcatacccagaatggtctctccaacccctcactcctgtgacaactggttcctctcgaaccagaatagtctactaaatacaagaaatgattcccacatgctcccagggactgaatcctgtatcaggaatggttatcccaccaagaaaggtctggctccctcaaccagatgaggaaatacttccctgcactccacatggtctgccctcccaccaccgcacacggaccctctagctaatgaatttttccttgctctacccacactcacaatgagctctctctgctataaggaaggacccggcactctcagaacgttctttctccaccatataacgatgagccctcccacccgaatgtacaatgaactctacctccattaggagggagcccccagaacggtctcctccgcacataatgaaagacacccccatcctcaaaatggaccctctctagtcacataaagaaggactcgccccaccctaactcacaatagtctctgtccctttataaggaaggaaccaccaccctcagaatagtctcccccttcttcagtgaggaactcccacacccgcagaatggtctcttccacacggaaggactccacatattcagaatggtttcggtggccttagccttcccaaaaagaattacccaccacactcacaatggtctctactctccatatgcggaaggatcccacaatcactctcagaatgttctcttccccgcccccaacacactgacaatgtgcacacacacacacacacacacgtcggtccacacgggatgctccctctcactttagtgaggaacattcccgactcccagcgatcccgacctccgcctcccatgcgactgctcgggcagactgtctcacccgcactggcggtccccggctccaatgcacccgcggaaaccgcccctggcccgggcgccgcggtggaaccaccagccccaaccgctgccatgttggcatctgcccggcccg

SEQ ID NO: 2314 - DNA, 2846 bp, Homo sapiens
attggcatgagagatgcaacaggctttattgttgcagcaacactaacatatacgccccattccctgctgaggcctgtccccacctcaccccttggttgtcgatggtgtggaacattggggtgaggggcaaaatgcctaagcagagctggagggaggcaaatgggactggtgagggtcgggatcacctggaccaggggtccaacagtcaggatacccgactccatccacacaggggcatggaacacttgggttctgagttcaagatttggcaatgtcttgacctgggttggaaggtagggtggggtctggaaaagctttggtccagggttcaagatttgagagtgccttgctccaggccccagtttggggatgagcatggagaagggtggatgggagtgtctctgggttcacaatttgaaattggccatggatgctctggcctgaagccccagttttggggctggatgtaggtggctcttggtcctaggttcaaggctggggaagactcttgtccctaggtaatgggggctgggtgtgagggatatcttagtttggggctggcgtgggggtagggcggtcacagatgtcctgttttgtttgggcagggggctctaggctcctgttttaagtgctgggaaagggctctgggtcccaattatgggctgggggtggggtggtattctccaggtcctgggtacagatcccaggggcctaggatccagcctcctgctcttgtcccagtgcctctagtagcaggcccattggcgtccgcttgagaccaatgctctcgatcttgttctcaatcttgttcttaaggttgcgcaggcgcaacgaggcgtgcaccaggatcactgtgggcggcaccgagaggggtggtcagtggaatagacctcagcctgcagccaaccggggcccaccgaagggaattggcgcgcaggcaggccaatggagtggtgagcagccaggacgcctcagatactgaaagcgtggccgagtaattggcttggcaacgtgggcatggccagggaagacgcccggtaacggggacgtggccagtggaaggcacttaacaccaagagtgagataggaaaggcgataataaaaggggtgttcccagaagggggaacgaagcccgggaaggcgcttttagcgggggcgtggcgaggccctcgggtttcccagccccctctcaacccggggaccggcagggctggcctggtgccttaagcatgctctggctgctttcctggctatctcggggtagtggagactcacgaagcaccggcccggcgatgctgaacaggaaggtgcaagcgccgcccgcgacccagagcaccaggaggccgacggcaagcactgcggccaggcaggctgcagggtggctgcggcggcagcggcgcacagctgcgcgggtctcagctgcccacaccagcacgccgagggccaccgccactaccagcgcgctcaggagcgtatgaagtggccgcacgtacctgcgggtacaagggaaccaagctagccggccgggcggagagacggcctccggaccaccacccaccctgggccccaagagccagggtctcccgtctccggacactccagcctggcacatcctcccaccagccctatctccagcaggcccatctgccagggctcccgactcacccttgtagacccctcctttcctccttgtcaattccactgtcctgtcttcctcaggtccccgcttcaggccctcccatcctgctagacactccccacacccccgggctcccaacacttccctggactttccttccgactctgcccccgtagggcccctcatcagcctgcccgcaagctccccctttaacaccagcccctgcaaatccctctttcaggccttctgtcttcacacgttcccctctccccaggcctagggtccttatagaaccgccctccaggctcccatttccctatagattcctccctccatcattgctaggacctcttccaggtcgtcagccccactctgaactttcagcactgctcaagtccttcctccagattctccatccctctctggtctcaggctttccaaccatggatcctcctcctgggcccaagttccccaacaggtacctgcccctggcgccttccaatcatagccaggctcccctccaagaccggatccccaataaatacatcttccaaaccctccaactttaccgtctatttcccggtctctgccctaagtactccagggtcggcctcaatctggccccatcattcacatcacaccccccctacgcccctcaagtactctcatgtccccctttcgggccctcctttttttccggttcaccttccagcccactttccccttcagtcccacacttgtctccatcctccccatatcttccttgcagacccccatcccccgcaggccctcctcatcagccaggctccatctccctgaggccctccttataactaggctccacctccttcaaggccccccttccaagcccctcaggccgtccatctctactgacttcgcccttcccggccttgcacctccctcaggttccccgtcctggtcctcaaagacctgtgggtctacccccacgctctgcagacgtccctggccaaccggcgcctccctccctcacccggcgagagcgaggccgatgccgaagcagagaaggtagttggtttggtagtagaggaggttgttgatgacgcggtggcaccatcgctgcgggtcgcatggatccggagccgccagacgcgccgaccccagaacaaagtcgtccagggcgcgtagcggtggcagccgcacctccgacatcctgccggttaatgtg

SEQ ID NO: 2315 - DNA, 11059 bp, Homo sapiens
tgtcttcagatacaaggctttgtttgtgcacagtgaacaaagggcatattgggaaggcctccttatattgtccacacttccctgaatgtaaggagccctgtcctcaaaatggggatcagcagggctcctttcaaggtaaagcagaaaaagtcccagtggcctgtcaagggagaccaggcgctttggctggagctaggtgttctggacaaagggccatattcaagaactttgggccccattttcaagcgtaggcttaggagaaagatgaattccaggaaatctgaagctgatgagatatctgctttagcattgtggcacggggaggagatggagggtgtctgaaatggccaggttatgttgtgttacaggcagagacagagccccagtgccattccctggggagctttagcccttctcaaaggtgctaccaaggctggtttattatgattggagaaaggaggaggcctccttgacagagtgaagtgcataaagcataggaaatggactactggacatgagaagttgggaacatcctccctacgattaacaaaatacaagccagagaccaggcacggtggctcattccagtgcctataatcccagcactttgggaggctgagacgggaagatcgcttgagcccaggagatcaatgctgctgtgagctatgattgcaccactgcactccagtctgggcaacagaggaagaccccaggctcagcatattctctggggtcctgctctaaactgagagtgaaagcatactctgctgctagttgctagagttcttgctcagaaagttgttcagagatacagtatttcagattccacagcatctaaagatttttttttttttttttgagacagagtctaactctgtcccctgggctggagtgcagtggcgcaatctgggctcacagcaacctctgcctcctgggttcaagcgattctcttgcctcagcctcctgagtagctaggattataggcgtgcaccaccatacctcggtaattttttgtatttttatacttttagtagagacagggtttcaccttgttggccaggctgatcttgaactcctgggctcaagcgatccatccacctcagcctcctaaagtgctaggattacaggcatgcaccactgtgcccaagcttatagtatctatattccaagagtgagctcacaatcaaatgagtcctttaacttgtcctgtaccctgagcagaaaagcaaggcttaaaagtgaaatggttcccacctcagtcaactcagttcccaccttaactcgcagctcatcataccacttatgatttcatctttctattaagtacttgaaatggtttttattataccctaaattttggtaaatattgggtttgtttctagcttccctactggttcacccatccctttcccttgtccttgtcccaggactgcaccagaagtagaggatggaacaatgatcttcccaccttctgaaggcaactttctcatatggtacagaactggtaccagcctgggggatgggaggagtcccatgggtcagtcatcatctgtgtcactagggcccatgtactggcagatggcatcgtagtgaagctccaccacctgattttctcttggcagttgcaccaaagcccggctccgtgctctgtcccggctcagcaaatgtcccacctggaacagaggtgaagtggaatcagcaaggcaagcctagatcctgggacaggccctgaacgacccacaaacctctactgccaggtctgagactcacccttccagtctgtgggcccagcaccaccatcacacggtcaccctctgccttgggaaccagggtctccagcatgtcttccctcaggcctatggataagggagaggggagtgaggcccacagcaaggaccagcccaaccagcgtcctgtcagaagggcctttcctggccaggcgtggtggctcacacctgtagtcccagcactttgggaggctaagttgggaggatcgcttgagcccaggagttcgagaccaacctgggcaagatggtcagacctcatctctacagatttttttgttttgttttttgagactgagtttggctcttgttgcccaggctggagtgcaatggtgtggtcttggctcactgcaacctccgcctcctgggttcaaacgattctcctgcctcagcctcctgagtagctgggattacaggcacccactactgcgtttggctaattttgtatgtttagtagagatggggttttgacatgttggtcaggctggtctcaaactcctgacctcaggtgatccaccctcctcggtctcccaaagtgctgggattacaggcatgagccaccgcgcccagcctacaaaaaattttaaaattagccaggcatggtggtcagtgcctgcagtcccagctactcaggaggctgaggtgagaggatggcttgaaaccaggaatttgaggtggcagtgatccatgatggtgccactgcactccagcataggtgataaaatgagacccaatctcagcatgtcataagatacagaagccaacctgaaagaactcctggtcaggtgcggtggctcacgcctgtaatcccagcactttgggaggctgaggcaggaggatcacgaggtaaggggttcaagaccagcttggccaatatggtgaaaacctgtctctattaaaaataccaaaattagctgggtgtggtagcgggcacctgtagttccagctactcaggaggctgaggcagaagaatagcttgaacccgggaggcggaggttgcagtgagccaagattgagtcactgcactccagcctgggtgacagagtgactctgtttcaaaaaaaaaaaaaaaaaaaaaaagaaaacttgacagactgggagagtggggctcaagataaccaaccaccatcatggaagtgtctaatgttctgtaagaggatgctaggccttgcaaaatacctgaactctgccaaacctcccagctttgcctgggccaggctctgggcctaaaacactcttcttgatcaacctccagctgccatcgctcaaactcaccttccaggactcggccttcatctgtccgacatacacaggtatctgggcttaggacatcttcaattatcatctggggatacaggtcagggggatgtgagattttagagaggtaggggggcccagtccctaggagagggagggggactcaggctgcagggttcccaccttggtgttgtaatattggcctcctttgtacatgttgtccacaaaccgcacacgcaggtccctgtgcaaccagtgctgacttctgggggctgctttctcactcttggctgcaggcccatcctgtctgtggagaaggtgccagcaccaggcttagctcttcatcagatgcactttccagttgccctccctttgcctatgctatgaaacccacccacaatgcagttccccgttccttctatgagcccgccttgccttggaagccttccctggctgctcgagcctacccacagccctgccttcttgacccctcccgcatgctcagagtcccaccggtctggaaggtgtttccgcttcctctctgagttgtcctgctggatgtagagttcttgattccagagggtcttccgtgatgaggcagttccgttctgttgccctggggaaggaagttttgctcatctggcctgttcaagaggttatgaggagaaccaggacagagcctcagtgtctcactgccctttccttccaaggccatgtctcagcctagagccacctcccacctgccaaagtgcccctctcacccctcatgcatttgctagtagaatgcctctcccccacctctcaaccatttcagcttccttcaggaaccctcccgcagccaacctagcccacaacaacaatgctcacctagtgtggactagagattcccagagagctctgtctgtacccatttgccaaactgccccgtcctaccgaaacgccttcgcctgtgctgttctgtctgcctagaattccttccttcttggtcacaccctaatcctagcagttctcactccctagtaaaagagaggttcatcaccccaaatggacaaagatctcgaaggtaggaattggtttctgcacctgtttcttctcactcagacaggctacagacccaggggtatgacatcgacctttctccaatcaaatggagtaagtcacttatgtccattctcacctcctgacctctgattggaagtcatatctgccaggcacactgctgcccctccctgctgcagatctaaaaccaccccattagccaggccctgccacccctaggaatgcgttgccaactcccctagctctacaagaggctcactcactgagatccaaggtgttcttgtcaaactcctgctgggagacaggccgcaggtagtactcactaacagtcaccacccggctccccacagccagacgaaccatggcccgaacattgtcaggatcaaggccttccacctaaagtgttgaggggaagaagtcaggtaggggttgtggactccacccacattcctaggaccaagatgtcaaccccttacctctaagaggcctgcttcctctgtctccccaaccagactctgacccctgagaagtgggaccaggtctggttcctgtgtctccctcagctgactgtggggcttccttggatcctttaagcatttaatcttcagggacttgtggcatatggcattctcttccttttagctgggaactgaggctcacaaaggccagcaagtggtcctgggttactgagtgaggcagtgggccaagcagacctaaaagactaggagtcccagcctttctacctcaaatccaattattcctccatctgaccctcggatcaaccttccctgctgcctgttttgggctcccgggatatcttggttccttaccttcccatagaggcctcggtgagggccagaaagaaccaccacagctcctccaggcaccagcccttgaggctgatcttccttatctttctcttgctcctcatctggtcttggcatgcgggaggggccagtgggggtcaaggcctgggcctcggtcaggttggcacccagccctaaccccttgggcctcagtgagttgacacggggcttcactactctgcagggaggaatatgggtttgttggagaggatgcaacagtcttcaacaccttatttacttcctcttcctgcccaaacccgccccacccgccccattgacattttcttttcttttctttttttttggagatggagttttgctcttgtcatccaggctggagtacaatggctcgatctcgactcaatgcaacctccacctcccaggttcaagggattctcctgcctcagcctcccgagttgctggggttacaggcgcatgccaccatgcccggctaatttttgtatttttagtagagacagggtttcaccatgttggtcaggccggtcttgaactcctgacctcaggtgatccgtcctctttggcctcccaaagtgctgagattacaggtgtgagccaccgtgtccagcccccaccaatattttcaaggttgccctttctgatctcatattaggactgtttttgacctacagaaacagcaatttcatttggttcaacctaataacatgctgcatataccatctattacataatatctacagtgagatcagaggcagatcgctgtaaccaaatatactatttctacaggggaaatcatatgaacattcacaccgagcaggagaaaccggattataaatactcaacatggttgggcatggtggctcatgcctgtaatcccagcactttgggagaccgaggttggtagatcacctaaggtcaggagttcaagaccagcctggtcaacatggggaaaccccatctctactaaaaatacaaaaattaaccaggcatgctggtgcatgcctgtaatcccagctactcaggaggctgaggcaggacaatcacttgaactcaggaggtagaggtcgcagcgagccgagattgcgccactgcatcccagcctgggtgacagacagagactccatctcaaaaaaaaaaaaaaaaaaaaaaaaaaaacgccaattcaggtcatatttggctgccaatgggttatgaaaaaatgtttggttttcagaattattgagtttgcaattgtgaagaaagggttgcaagtctgcatgacaatagcaaatgtttagtctacgctttcttggggtcagggcctactgtatgtgctttatgtatataatttcttttccttttccttttttttttttttttgagacggagtctcactgtcacccaggctggaatgcagtggtgcaatttcggctcactgcaagctccgcctcccaggttcacgccattctcctgcctcagcctcctgagtagctgggactacaggcacccgccaccatgcccggctaattttttgtatttttttttttagtagagatgggctttcaccgtgttagccaggatggtctcgatctcctgacctcgtgatccacccacctcagcctcccaaagtgctgggattatatgtgtgagccaccacacccggccctaatttcttttcttaaaattaattaatcttttgtagagatggggcctccctatgttgcccaggccagtctcaaactcctggagttaagtgatcctcctgcctcagtctccgaaagtgctgggattacaggcatgagccactacctggcctatgtgtataatttcatttaactctcacaacagacctatgaagtcagtactattacccccatttttcagatgaggaaattgatgtccctagaggcaaactttatataaatgggattctattagagtttcaaagggcaaatgggagtttaaaacagtagtggaaggggctgctgaattagttagggcgataatgtatcctccctccctgcctaggtggttctggtttggcagtgaccctggggatcttgattgcagcctgatgatctgtctgtcccctcgaccctatcccagaactcactgattgaaggtgcggccgatgccctcgccaggtttccagcccatgccccgcagcatggccagcccataggcctccacggggaccgcctcataattagcctcctctggcacctacaggttcaggtagaggaaggagggtcaggctttgcttacactgggtcttctatttgaagtgcacttgctgccccccactgggagacctgctacgcgtcttttccaatcagctcaagggtgagttttgatttcctctttccatccctcactgtactcctccatgttcagtccttcaacaaatataaagcaccttgtctatggcaagtactgttctaggtactggggatgaagctgtgaaccaaacagacaaaaacccctacccctgcagagcttctgatctagttgtggagacatactataaataaaacccagaaaacatgatatgtcaggtggtgatgtaaagaacaagaaaacagggtaagaagatgcagagggatggagagggagtgccactgggttgacatttaagcagagatcaggagatgacagcagagggagccatgaggatatgagaagaaagtgtcccaagctgaaagcatagtaacagcaaaggccctgaggccggacaaggcttggtatgtgtgaggggtatcatgaaagtcaccatgactgaaatggagagagtgagagtagacagcagagaagggtggggaagagaccaaatcaggagagctgggcaggagtcagaggaccttgagccaggtgggagccacaagagggaccagtgaggaaattactctaatagtccagatgagagatgctggtggctcagccctttgcagtggtattggtggtggtgagaagtggtcagttctgggtgtcattttgaaaaaagatgataggattgtgctggcatattgtatggggcacgaaataaagagaggaattgaggatgactccaaggttttcttttttttttttcttgagatgaagtcttgctgtgttgcccaggctggagtgcagttgcatgatctcagctcactgcaacctcagtctcctgggttcaagcgattctcctgcctcagcctcccgagtagctgtgattacaggcacgtgccaccatgcccagctaatttttgtatttttactagtgatggggtttcgccatgttggccaggctggtcttgaactcctgacctcaggtgatccgctggcctcagcctctcaaagtgttgggattacaggcgtgagccaccgcccctggctgactccaaggtttttatgctgagtgagaggaaggatggatggaatttttggtcacctgatatgtagaaagctgcaggaggaggtttatagagggaaaaattagaagaatgaggccaaagctggaacaggatgaaaggatgaagagggaagtgaggatcttttttttctttaaagatgaaggagctgggcacagtggctcacgccggtaatcccagcactttgggaggctgaggtgggtagatcacttgaggtcaggagttcaaggccagcctgaccaacgtggcgaaacctcgtctctactaaaaatacaaaaattagccaggcggtagtgacacgtgtctgtaatcccagctacttgggaggctgaggcaggagaatcgcttgatcccaggaccgggaggttgcagtgagccgagatcacaccacttcactccagcctgggcgacagggcaagactctatctcaaaaaacaaaaaacaaacaaacaaaaaaatgttgaaggaaaccagggcacatctgaaggctgaagagaacagttcagttgaaagagagagtggtgtggggctgtaggagaactagactcaaaagaagcagtgcaagaaatttatgaaagaagaggtgaaaagtcaggtctgtgggtatgaaagacagacttggttacttctgtagacatgcctctcacgtcccctcttgtcacctcccatcatcactccttcccattcactccagatacaccacatgttgcctcactgatggacacaccatatcgattttctaccactatgccattgcttgggctgttactactaacaggagtactcactctgttcttccctctctcactaaaccctacttatccttccagaccactctggtctaagtccccagcatctctagcctggactactcatccccttgcttccaccttcactaatgagtctgttcacagcttccagagggatactgtcaaatcataaatcatatttcatctatgctcagggcttgtccaggctctcatctcactcagagtaaaagccaaagtcctcacaatggcctacaaggccctgcctggtctagcacccccatctcctttctgacttcatctactaccccttccccttactcattccacttcagtcacactggtctccttggtgttccgcaaacactttaggcagtgtctaccttcagggcctttacatttcctgttccctttgctgcacacctcattcagataatcctaggattcaagtacgtttttagcatccagatacccagattcatttggtaatgcttccaaaatgatgacagaaggggcaggtggcgggcctctagcacacacacagactttccctgctacgtgcagggacacagcctggcggacagggcaaagaaaggctggggcaggagggggacaaggggccagctcactgtctctgcccggggttcgctgtctgccccttccccgctgggggtgcatcctttctggatcatggggatagcgagcgtggggtcgacacccgcattctctctctcttccagagacttcttggattctaaaggaagaataggagggagcaatgaagtcccactctatccttccaccttcttcctcttcttccttcaatggggaagggtaaaggggtatcactcacccgcaatgagctccttcacagcctgggacaccaccccatccgccaaggccccagtatctgtggatggcccagggggccgggctggtggctgcctgcgatggccattctggatcaaagggatgacgagttccttgggggcctcctggggcttcacactgatgtggacacagaggggtggggttgggagaatggcagggtcagtgggtcacactccttcattcagagaaaacacaagagccaaactcaccccagccccacagaccatgtcttccctactccatgtctggatctcctgttcctctctgatcgtgcattctctggattatctccccagtgcccccaactcataaatgtcagtgccttcgagaaataagtcctgcactctctgtttaactcaataccggcttctacaatggcccacaaatcactatcttcagcccagaccttccccagctccaggttcccaaacagcttcctagatgcctgattctcttctggaaatccctccctcagacccctcagacactcctctcctcattaagctgatggtggcctccatcaacctgaatctgccgctccatcccgttccccatatcggggacgcctcagcccttcagttgagacactagcaggtcctgtcattttctcattctttccttctcccagaacgcacagaccttagtgtcttcaagtcctagagacacttcttctcagtaatacatcctctcttcgcaattcccacagctatcaggcccaatttcctcaccccctcctataaactcccgccttctggcctccacgaatttactcaggctgtgtttcaggcttaacaggtcactgtcaccaagacaaacaactgagattcctccctcccgcttacgcccaccgcagagatttccaaggggtgaaagacccggcgcgtcacctctgcagctccctcccttccacggttttcaagaaatccttctcctccggagatggccccgcgccgtctcccgagtcggccagccgcctccgtgcggacgtgcgagtgaagccgaatgaaattggggcagtggaagcagccgtcagcggcaaaacaccctctttggagtcagccatcttgctc

SEQ ID NO: 2316 - DNA, 10989 bp, Homo sapiens
catctgccactgctgctgactgccactaccagccggagccagggcctggtcgagacaactatttttgaggtatctgaggctaccccacagcactctctggcattggtgagcacctgggagcagtgggcccagggtgcgagggggataagggcattggggagctggggcagggtgtactgaagttcccttcggtagagagctaggtctgtgggagaggcacaccaacaatgcagggcagggtggtggtgggggggtaggggggcagtgagaatggagggcctgaggacaggggcaaagcccaaaacaccaatttcctttcctggcaccaagccgattcccggccggaaatggacgaggagggatcggggaaaagagaagtatgagtccccccttctccaccctatccctgcttcctttcctccccgccaggagtagcctctgtcctcccccaacccagggcccagctctccaagaaagaccagactgggctactaagaaaccattactcaggcacctgcctgcctatgcctgatttgttcactgcagtggaggaagcaggggctctggggagggtaatggcccagacattgagattttgtatttgctctaatagtggcaggatgtggaaatgaccccccaagtgttggggtgccacccaggtgaggtatcttggttgtaaacagttattacagccaggaatttctttctcggctgtggtgtcagaatggcagacctgaaaaacctgccgggcccgcctctgggtgtggggggtgccctctactgctctcccgctgcagctggtccctgggacaggatgggggccatggggtcactggtagggggagacctggggttggtgtgggggtgtgctggggaggggtttgctgggatccctttctcgccatctgggcggggatgaggcagctccaggccccaaggcaagtatgcagagggcaggtgagcggaggcagaagcttaggaactgggtgtgggggtgtggggcgttgactgtgtctagcctgcccagtgaccccatgactcatactctaactatgtccccccgaggtcgggctgatagggaggagttggggttcctgtgtggaccctgtctggacttccaggacgctctgagaaattagagaagaaaggattggctgggtgcagtgcctcacgcatgtaatcccagcactttgggaggccgaggcgggtggatcacctgaggtcaggagttcgagaccagcctggccaacatggtgaaacccaatttctactaaaaatacaaaagtagccaggcatggtggcgtgcacctgtaatcccagctactttggaggctgaagtgggagaattgcttgaacctgggaagtggaggctgcagtgagccaagatcgtgccaccactgcattccagcctaagtgacagagccaggccctatctccaaaaaaaaaaaaaaaaaaaaaaaaaaaagaatcgaagcagcccagcatggaattgggattggattgggaccaatgctggcaagggggaccgtggatggagttgggttcctgtgggggtaaaggaaggttccagggaaccctgtgagagttccttgggcctaaatgggggctgggaaagttggagccccagtgatctgggatgtggaggaacccctgccatgctgggaagtgtcagaccttagatgagtggggatgtggggcctgggtttgtcaaaaggctttagggactgatccccacccctgctgttgaaggcagggcaccactgcttcaagagaggggtacaggccctatggggcaggcaggaggactgcagagaaacatgacaccttacaagcagcttggcctcaccccacaatacacagatggggaaggggcttgaacccatgcctccttggttggctgggtcttcctcacaccaggctaacatgtcatgacaagctgccgacttcaaggtaggtgataatggagctctgtggccccataaagccctcccagtcacctgccacctaggttaggccaggtggtgggaggtgatgtcactcagctgcccagctggggactgagcatgatgtggaaggaagggagcaaactccagaggaggggtggccagccaaggcaggttccatggtcagctgagccatcgggggcagagaaggaggcaggaggcaggtggttcgttatttgcagctgtggactttgcttctcacaaatcccagcaggaggacttccctacactaggctcaggacaggctgtcatggcaagaggggctggagggaccctgggtcaagtgaacattctccttgctacactagagctacagaatggagttgggacaagcacagacccacagatctgagcttgaaccctggctccaccgcctcctcatttacttactctatcttttattcattcagctggcacccattcattgagcacttgtgtgtacagccatgttcagggtgctggtgatgctgctgaaaatgggacagataatgtttcctgtcctcgtcgatgttccaggaggcacaatctcttgttggacaaccgtttgtgagaggatataactgtggaagtgataattaagttctagaatgataagtgtgatgcaggggctggggtggtgagaggttgaagaaagcacttcaggcagcatccacagcctgggcaaaggccctgaggcctgagggaccagggagcttatgaggaagttggtggagttagagcggttctcatgagcgagagtgtaggaccagaggggtgggcctggtttatgtctgtggctatgggccagttatttcacctctgtgccttcctttcctcatctctaaaatggggatacgaatctttccgggtggctctgaagattgagtgtggcatcataggtaactgttgcaggcacccaggtgttgactgcgtgtccattgttgttatagttggttgaatctgtcccattaattctccttccccaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcaggcacgtggggcccaggttaccccttattccccgctgtggcatgggaagctgggaagggctgggggttggggtatcatgggatgtgcttccttaacggttcctttgtgtcactgccagactttgtccagccatcagccacggcctctcgacagcaccaagatggaagtcaaaggtcagctgatcagctctcctaccttcaatgccccaggtcggtggctgcttcccctcctgctgcctcctcccctgctctgaatcaccacctgcttgctcgggaagagttggtcccttgccccacagctgctccagaatgccctggctgtcccactgatctttgctccctctgtgtccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggtgagggcctggccctaggggtatcaggcggggaggttgggaggaggtgaggagctggggcccctaggtagacagacttgggtggcaattcctcaaccacttgtcttggctgtagattccctgtcacctactttctcctcaaagctcagcttagatgtgttagaatgaatgaaataggctgggcgctatggctcacgcctgtaatcccagcactttgggaggccgaggcaggtggatcacctgaggtcgggagttccagaccagcctgaccaacatggagaaatcccgtctctactaaaaatgcaaaattaggctgggcgcggtggctcacgcctgtaatcccagcactttgggaggccgaggtgggcggaacacgatgtcaggagatcgagaccatcctggctaacacggtgtaaccccgtctctactaaaaatacaaaaaattagtcaggcgtggtggcgggcacctatagttccagctactcgggaggctgaggcaggagaatggcatgaacccgggaggcggagcttgcagtgagccgagattgcgccactgcactccagcctgggtgacagagcaagactctgtctcaaaaaaaaaaaaaaaaagcaaaattagctgggtgtggtgatcctagcaacttgggaggctgaggcaggagaatcgcttaaaccctggaggtggaggttgcggtgagctgagattgcgccattgcactccagcctgggcaacaagagcaaaactccacctcaaaaaaaaaaaatatggtaatagaggcccactgttgacaatttcaaatccaacaaacctcagaaaacaggttctgtccaaaatttggcagcacagtctgacctgaactggcacaggctgatctgtagtttcagtttacccctcttactgtgaatgcccacagtgtgccggaaataatactacagctcagaccacgcagccacagcccctgaagtgagttatataatgcttaggatctcgatggtatcacctttataaaaacaaaacaattctggattccaaagcaggtctccctgcctcccatgcccaccaccccaggggtttgggccactgaggtttgggcacacctgcctagtggagatactggtaggagggaggggagtatcgtgcgtggttgctgagcagggccaggctcctggtaggacttctgtagcttctgggatcattaatgcttcaccccatccttccaactaacccttggtagtctctgacccctgcctcccaccaggagctgactggccagctgccccctgagtgcccactagagcctggtgaacggccccagttggtccgccggcggccccccacagcccgcgcctaccctccaccgcaccccaaccaagcacaccactccttgtgccctgctgaggtgagcagatgggtgtggagagcaagagggtgggaagaggggacaggtacagaggagtagccaggaggaaggtgtggggagggggcttgtggccaggtgagggagaggctaagatgagaaggaaaagggcttctggagttagtttcctgtgatgagggaggatgctggtccctaactgtcaggacaggcctccaaccctaaggaagatgaacagacccagcccttcaccaagagaggccctgacacgccccctccccggggtgaataggtctgaataggctgcaggaagtgcaggccagcctctactgggtttggccccgccaggtccctgttcctggccatttccaacatttgggtgggcccaacaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcagaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccaggtgagaatgagcccctcctcccctccgcaggagctgggaatgggatagcaagcctgggctggcagagggtctgctggtgggtacagtctctaacctaggcctgcctgtctctgtctagccccacacgctcgctgcccaggagtgcctccagttttgaggggcgaagtgtgcctgccacccctgtcctcacccggggcgctggcccccagctctgcaagtaaggggaatctgagggtgggctggaggatcagaggggagggaaccattagttctcactggaagcttgaggacaacattatcaaaaggtgggatggctgggcgcggtggctcacgcttgtaatcccagcactttcggaggccgaggcgggcgggttacttgaggtcaggggttcaagaccagcctgaccaacatggtgaaaccctgtctctactaaaaatacaaaaattagctgggcatggtggggcatgcctgtaatcccagctacttcggaggctgaggcaggagaatcgcttgaacccgggaggcggaggttgcagtgagctgagatcaacatcgtgccattgcactccagcctgggcgacaagagcgaaactccgtctcaaaacaaacaaaaaaacaaaaggtgtgggacatgggaggctgggcattaaaggtgagcaggcatctcggtggataatggggtaggagtcagtctcctcatttgtgaaatggaaataataatatctgcctttgaaagacatggacataataagttctggttagcatatactgagtgcctgccatctgctaggaattagtgttttacgtggcatcaactcatttaatcataatcagatccctgtgaggtgggtgctattgttattcccattttatagatgaggcaagtgaggcacagaaaggttaagtaacttgttagtaaactgaagtcctggagtttgagcccaggcaagttttactctagagtccatgcttttaaccactgtcctcttctgcttcttaaacagagtgcctactttccccaggctctgaacaaaaccaagtccccttccttgtggggcttgcattctgtgaacggtggctgttgggatggtagctttgggtggttcatacgtatggtgggatagagaattcaggcagggttttacatgtgagccctaaggcctaggacttaatcctggaggccgtgcgagccgagccatgagaacggccttagcagggggaggggtcagctggattaggaacagccccctgcccggcatctactctgctagcctttcctctgagtccctacacagatttacacctcccttggagctaacagtgccaggcctcccccacgcatttctacccctgaccgcctagcctaggatagaacctcagctgccctttacatgtcactacctgccacctttatacacacagcttccaaccttgggcccatttggagatgtgaaagtgaaggcttagaaagggctggggtagggagggcactgcacgccttctgcctgatttttctgaccctattcccatgaccctcgcctctcaccccagacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccca

SEQ ID NO: 2317 - DNA, 10996 bp, Homo sapiens
gccaaggcatctgccactgctgctgactgccactaccagccggagccagggcctggtcgagacaactatttttgaggtatctgaggctaccccacagcactctctggcattggtgagcacctgggagcagtgggcccagggtgcgagggggataagggcattggggagctggggcagggtgtactgaagttcccttcggtagagagctaggtctgtgggagaggcacaccaacaatgcagggcagggtggtggtgggggggtaggggggcagtgagaatggagggcctgaggacaggggcaaagcccaaaacaccaatttcctttcctggcaccaagccgattcccggccggaaatggacgaggagggatcggggaaaagagaagtatgagtccccccttctccaccctatccctgcttcctttcctccccgccaggagtagcctctgtcctcccccaacccagggcccagctctccaagaaagaccagactgggctactaagaaaccattactcaggcacctgcctgcctatgcctgatttgttcactgcagtggaggaagcaggggctctggggagggtaatggcccagacattgagattttgtatttgctctaatagtggcaggatgtggaaatgaccccccaagtgttggggtgccacccaggtgaggtatcttggttgtaaacagttattacagccaggaatttctttctcggctgtggtgtcagaatggcagacctgaaaaacctgccgggcccgcctctgggtgtggggggtgccctctactgctctcccgctgcagctggtccctgggacaggatgggggccatggggtcactggtagggggagacctggggttggtgtgggggtgtgctggggaggggtttgctgggatccctttctcgccatctgggcggggatgaggcagctccaggccccaaggcaagtatgcagagggcaggtgagcggaggcagaagcttaggaactgggtgtgggggtgtggggcgttgactgtgtctagcctgcccagtgaccccatgactcatactctaactatgtccccccgaggtcgggctgatagggaggagttggggttcctgtgtggaccctgtctggacttccaggacgctctgagaaattagagaagaaaggattggctgggtgcagtgcctcacgcatgtaatcccagcactttgggaggccgaggcgggtggatcacctgaggtcaggagttcgagaccagcctggccaacatggtgaaacccaatttctactaaaaatacaaaagtagccaggcatggtggcgtgcacctgtaatcccagctactttggaggctgaagtgggagaattgcttgaacctgggaagtggaggctgcagtgagccaagatcgtgccaccactgcattccagcctaagtgacagagccaggccctatctccaaaaaaaaaaaaaaaaaaaaaaaaaaaagaatcgaagcagcccagcatggaattgggattggattgggaccaatgctggcaagggggaccgtggatggagttgggttcctgtgggggtaaaggaaggttccagggaaccctgtgagagttccttgggcctaaatgggggctgggaaagttggagccccagtgatctgggatgtggaggaacccctgccatgctgggaagtgtcagaccttagatgagtggggatgtggggcctgggtttgtcaaaaggctttagggactgatccccacccctgctgttgaaggcagggcaccactgcttcaagagaggggtacaggccctatggggcaggcaggaggactgcagagaaacatgacaccttacaagcagcttggcctcaccccacaatacacagatggggaaggggcttgaacccatgcctccttggttggctgggtcttcctcacaccaggctaacatgtcatgacaagctgccgacttcaaggtaggtgataatggagctctgtggccccataaagccctcccagtcacctgccacctaggttaggccaggtggtgggaggtgatgtcactcagctgcccagctggggactgagcatgatgtggaaggaagggagcaaactccagaggaggggtggccagccaaggcaggttccatggtcagctgagccatcgggggcagagaaggaggcaggaggcaggtggttcgttatttgcagctgtggactttgcttctcacaaatcccagcaggaggacttccctacactaggctcaggacaggctgtcatggcaagaggggctggagggaccctgggtcaagtgaacattctccttgctacactagagctacagaatggagttgggacaagcacagacccacagatctgagcttgaaccctggctccaccgcctcctcatttacttactctatcttttattcattcagctggcacccattcattgagcacttgtgtgtacagccatgttcagggtgctggtgatgctgctgaaaatgggacagataatgtttcctgtcctcgtcgatgttccaggaggcacaatctcttgttggacaaccgtttgtgagaggatataactgtggaagtgataattaagttctagaatgataagtgtgatgcaggggctggggtggtgagaggttgaagaaagcacttcaggcagcatccacagcctgggcaaaggccctgaggcctgagggaccagggagcttatgaggaagttggtggagttagagcggttctcatgagcgagagtgtaggaccagaggggtgggcctggtttatgtctgtggctatgggccagttatttcacctctgtgccttcctttcctcatctctaaaatggggatacgaatctttccgggtggctctgaagattgagtgtggcatcataggtaactgttgcaggcacccaggtgttgactgcgtgtccattgttgttatagttggttgaatctgtcccattaattctccttccccaggcaagactcgtggctgtgacccatgggcctctgaggaggcgttgtaagtccgcccagctccccacttgctgtgctctcactcaatgcgaagggaaccaaggtaccagggccaagtgggtccagacatccacacggattctgaaagggcaggtcaagcaggcacgtggggcccaggttaccccttattccccgctgtggcatgggaagctgggaagggctgggggttggggtatcatgggatgtgcttccttaacggttcctttgtgtcactgccagactttgtccagccatcagccacggcctctcgacagcaccaagatggaagtcaaaggtcagctgatcagctctcctaccttcaatgccccaggtcggtggctgcttcccctcctgctgcctcctcccctgctctgaatcaccacctgcttgctcgggaagagttggtcccttgccccacagctgctccagaatgccctggctgtcccactgatctttgctccctctgtgtccagctgccctgttcggagaggctgccccccaggtgaagtcagagcgtctgcgggggctgcttgaccggcagcggaccctgcaggaggccctgagcctgaaacttcaggagctccgcaaagtgtgtctccaggaggcggtgagggcctggccctaggggtatcaggcggggaggttgggaggaggtgaggagctggggcccctaggtagacagacttgggtggcaattcctcaaccacttgtcttggctgtagattccctgtcacctactttctcctcaaagctcagcttagatgtgttagaatgaatgaaataggctgggcgctatggctcacgcctgtaatcccagcactttgggaggccgaggcaggtggatcacctgaggtcgggagttccagaccagcctgaccaacatggagaaatcccgtctctactaaaaatgcaaaattaggctgggcgcggtggctcacgcctgtaatcccagcactttgggaggccgaggtgggcggaacacgatgtcaggagatcgagaccatcctggctaacacggtgtaaccccgtctctactaaaaatacaaaaaattagtcaggcgtggtggcgggcacctatagttccagctactcgggaggctgaggcaggagaatggcatgaacccgggaggcggagcttgcagtgagccgagattgcgccactgcactccagcctgggtgacagagcaagactctgtctcaaaaaaaaaaaaaaaaagcaaaattagctgggtgtggtgatcctagcaacttgggaggctgaggcaggagaatcgcttaaaccctggaggtggaggttgcggtgagctgagattgcgccattgcactccagcctgggcaacaagagcaaaactccacctcaaaaaaaaaaaatatggtaatagaggcccactgttgacaatttcaaatccaacaaacctcagaaaacaggttctgtccaaaatttggcagcacagtctgacctgaactggcacaggctgatctgtagtttcagtttacccctcttactgtgaatgcccacagtgtgccggaaataatactacagctcagaccacgcagccacagcccctgaagtgagttatataatgcttaggatctcgatggtatcacctttataaaaacaaaacaattctggattccaaagcaggtctccctgcctcccatgcccaccaccccaggggtttgggccactgaggtttgggcacacctgcctagtggagatactggtaggagggaggggagtatcgtgcgtggttgctgagcagggccaggctcctggtaggacttctgtagcttctgggatcattaatgcttcaccccatccttccaactaacccttggtagtctctgacccctgcctcccaccaggagctgactggccagctgccccctgagtgcccactagagcctggtgaacggccccagttggtccgccggcggccccccacagcccgcgcctaccctccaccgcaccccaaccaagcacaccactccttgtgccctgctgaggtgagcagatgggtgtggagagcaagagggtgggaagaggggacaggtacagaggagtagccaggaggaaggtgtggggagggggcttgtggccaggtgagggagaggctaagatgagaaggaaaagggcttctggagttagtttcctgtgatgagggaggatgctggtccctaactgtcaggacaggcctccaaccctaaggaagatgaacagacccagcccttcaccaagagaggccctgacacgccccctccccggggtgaataggtctgaataggctgcaggaagtgcaggccagcctctactgggtttggccccgccaggtccctgttcctggccatttccaacatttgggtgggcccaacaggagctggctcttgaggccctggaacgcgaggtgtcagtgcaacagcagatcgcggcggccgcccgccgcctggccttggcccctgatctgagcaccgagcagcgccggcgccggcgccaggtccaggcagatgcactgaggaggctgcatgagctagaggagcagctcagggatgtccgggcccgccttggcctcccagtgctcccgctgccccagccactgccactgtccacggggtcagtgatcaccacccagggagtctgcctgggcatgcgtcttgctcagctcagccaaggtgagcatcccctggtgagggtgggagagtggacactggcaaatggacgtggtagggctgggatgggtgactggccggtgaaaaccgggaggtaggcacaactcaagtggcccaacccgtgagaagagttgcgacaaactggcttaccggaaaggacaaactgtgggggactgatgaatatctgccaggacagtcaggaaccaaactggggtggtcttgggctctggtaaaagcagattcttgggacaggaacaggatgaggcggaaactggccagaaggtggcccaagtagaggtgcccacccagtggtgtaagggggcagcacccaggcctgggagtgagaggcccacttctccccctctcacctgtagaggacgtagttctgcactcagagagcagctccctctcagagtctggggccagccatgacaacggtgaggactcctatcccccaaacctgcccccgactcctacgtccctttagcccatcccctttattcatccgaccacatcctgcatgatcagcccatcctttgatgcccagcccctcctgtgctgcttcagcttctccttagccatgctccatcttcctatgggtcccccatcttcttagcctcaccccaccccagccccacagccccagaacctacttgtcagccttagttcctcctcagcctgcttaacctgtcccagcactttgcccctccccatggccttgccccccagcctgtcctgccccctctgggcccccctcattgaattctatcccacttgctctcttccactcagaggagccccatggctgcttctctctggccgagcgcccctcaccacccaaggcttgggaccagctgcgggcagtatctggggggagccctgagcggcgaaccccatggaaaccacctccatcagatctttatggggatctgaagagccggcggaactctgtggccagccccaccaggtgagaatgagcccctcctcccctccgcaggagctgggaatgggatagcaagcctgggctggcagagggtctgctggtgggtacagtctctaacctaggcctgcctgtctctgtctagccccacacgctcgctgcccaggagtgcctccagttttgaggggcgaagtgtgcctgccacccctgtcctcacccggggcgctggcccccagctctgcaagtaaggggaatctgagggtgggctggaggatcagaggggagggaaccattagttctcactggaagcttgaggacaacattatcaaaaggtgggatggctgggcgcggtggctcacgcttgtaatcccagcactttcggaggccgaggcgggcgggttacttgaggtcaggggttcaagaccagcctgaccaacatggtgaaaccctgtctctactaaaaatacaaaaattagctgggcatggtggggcatgcctgtaatcccagctacttcggaggctgaggcaggagaatcgcttgaacccgggaggcggaggttgcagtgagctgagatcaacatcgtgccattgcactccagcctgggcgacaagagcgaaactccgtctcaaaacaaacaaaaaaacaaaaggtgtgggacatgggaggctgggcattaaaggtgagcaggcatctcggtggataatggggtaggagtcagtctcctcatttgtgaaatggaaataataatatctgcctttgaaagacatggacataataagttctggttagcatatactgagtgcctgccatctgctaggaattagtgttttacgtggcatcaactcatttaatcataatcagatccctgtgaggtgggtgctattgttattcccattttatagatgaggcaagtgaggcacagaaaggttaagtaacttgttagtaaactgaagtcctggagtttgagcccaggcaagttttactctagagtccatgcttttaaccactgtcctcttctgcttcttaaacagagtgcctactttccccaggctctgaacaaaaccaagtccccttccttgtggggcttgcattctgtgaacggtggctgttgggatggtagctttgggtggttcatacgtatggtgggatagagaattcaggcagggttttacatgtgagccctaaggcctaggacttaatcctggaggccgtgcgagccgagccatgagaacggccttagcagggggaggggtcagctggattaggaacagccccctgcccggcatctactctgctagcctttcctctgagtccctacacagatttacacctcccttggagctaacagtgccaggcctcccccacgcatttctacccctgaccgcctagcctaggatagaacctcagctgccctttacatgtcactacctgccacctttatacacacagcttccaaccttgggcccatttggagatgtgaaagtgaaggcttagaaagggctggggtagggagggcactgcacgccttctgcctgatttttctgaccctattcccatgaccctcgcctctcaccccagacctgaaggccttcattctcgtcagtggtccggcagccaggactcccagatgggcttcccccgggcggaccctgcctccgatcgcgcctccctcttcgtagctcgcacccgccgcagcaacagttctgaggccctgctggtggaccgggccgctggtgggggagctggctccccgcctgcccctctggctccctctgcctctggccccccagtctgcaagagcagtgaggtgctgtatgagcgcccccaaccaacccctgccttctcctcccgcacagcaggccccccagaccctccccgggccgcccggcctagctcagctgcccctgcctcccgaggtgccccccggctcccacctgtgtgtggagacttcctcttggactattccttggaccggggcctgccccgcagtggcggtggaacaggctggggggagctgccgcctgcagctgaggtcccaggacccctctcccgccgggatgggctcctcaccatgctccccggcccaccacctgtgtatgcagctgacagcaacagccccctcctccgcaccaaggacccccacacccgtgccacccgcactaagccctgtggcctgcccccagaggctgccgaaggccctgaggtgcatccaaaccctctgctgtggatgcccccacccacccgtatcccctcggctggtgaacgcagtggccacaagaacctggctctggaggggctgcgggactggtacatccggaactcgggactggctgcggggccccagcgccggcctgtgctcccttccgtgggcccgccacacccacccttcctccatgcccgctgctatgaggtgggccaggcgctgtacggggcccccagccaggcgccactcccacactcgaggagtttcacggcgccccctgtctctggcaggtatggggggtgcttttactgatgggtaggggtctcgtaaggcagatggcgaagatatccaggccagggagtggctagtcatgatagctaatgaattggaccatgaggaaactagctgctgtgatggcacagggtcactctactgcacatgacctgcattagtccatggggtcctggtggaggggatcttgggcactggtagcagcaattctttatcaagttataggctgaagatgagccttgaagccagggtgccgggaggaagggacatctcatgccccttgctgttttcttccttttttctccatgccccagagcctgaaagtgctgtcctgtgcctgcctccacctctttaacgagcctcttttcctttctttttctgtgtcttgtctgtcttttcttcttcttgtcttccccgccctgtcctccggattcctgctaccccttctaaagatactacgcggacttcctgtatcccccggagctgagcgctcgtttaagtgacctgacgctagagggggagcagtcctccagttctgacacccagaccccggggacactggtctgaccccttctgatatgtcccttgttggcctgggcacgattccaatctggggagcacacagctgacctcgctgggccctggggtgtggttgctctcagtcctgagcagagtgcgccaacctaatcttccaaggcccctggctccccgtaggcccaggaaggtgtctgacaccctgcttcttctctcacactgtgctggggactgggggccctcagctagcttaaaagaggggggatgatgtcatggggaccccaagccccttcctccatttatgtttacagttgtgacttaggtattcactgtcttcctccaacactaggcgttttacaaaagggaaactgtgatctcatctggttgggttcattcctgttcccatgcccaaccaggttccattcaggaaccccctccataaaatggaccatatcgggtctcagggccatttagggcagccaggagactccggtgtgaacagaaatccctgccacgcatcgccagggcagttggggcagtgggctctctgcccacacttggaaggactgcagtctgggtgggatgcctgaaagagcccaaccccctctgtgcccatggcctctgccctgaccacccccagtcaggaggccccacaggaggggcacccggtagatgccagtgaaatcctcaggggaggtctgcctgaaagagcccaaccccctctgtgcccatggcctctgccctgaccacccccagtcaggaggccccacaggaggggcacccggtagatgccagtgaaatcctcaggtgaggtctgcctacgggccacgggccactcaccactcacaccttccttggctttccttccacccttttttttttctcgagacggagtcttgctctgtcaccaggctggagtgcagcggcgcaatctcagctcactgcaacctctgcctcctgggttctcctgcctcaccctcccgagtagctgggattacaggcacacgccaccatgcccggctaatttttgtattcttagtagagacaaggtttcaccatattggccaggctggtcttgaactcttgacctcgtgatctgcccgccttggcctcccaaagtgctgggattacagccgtgagccactgcacccagccccaatccaccactttttaagcaaacccacacaagttgtgttttctatgatacctgtctgtgattttcggagctgggggttcccctacccccttttcctggcgttaagcttttctttttataccagtggatctggacccaagacattacccacactggaaggggatttgtataataaatgtgtaaactgaaccca

SEQ ID NO: 2318 - DNA, 10996 bp, Homo sapiens; identical to SEQ ID NO: 2317

SEQ ID NO: 2319 - DNA, 25969 bp, Homo sapiens
aagccgtaaatgccattaagggccttttattcgtattcatcacatcggagatcatctcttcctaggaagcttttaaaaaatccccaggttggattagggcactccctctgggtccctggcaatttcctccaggttagggatcccaaggggtcgctgccttcctgggtctctggcctggcccttggggcacacagtcatcaagaagtgctggggggaagtgagctctttatttagacatagctctgctgagtggaaagtgggcaccagccccattaatgcttgctggctggtggcttccaagcacgccccactgccaaggctcagctctgcagttctgccactgcaggtccctagcacagcccccagggtccttaaaagtcatcatcatcacagatgtcaaggtacacgtcgaaagcctctctgttgcagtttccatcaggagtgaagacatatttgtggaaggtcccatctacgcagatggctgggggagggggggtggtaaaaggtcagaggctgccacagccacaggctccagtcctctcaggcatctcaggacctagggtctgcctccaggcctttgcccagtgctgtcccccttactgatgatgaagctgagcctcacatggccctaaaatcctttcaggtccaacctgcaggcctttgccccatgcagtacccccaaccaaggggctgttcccactcaccaatgacagagttgacgttcttggaagtattgcgaccgaaggcgcagatgcaagctgactcagcaggcacagtgaagctcgccaggctccactgagagtccacgtactgcccaatcataggccccaccttgcccacgcgagccagcctgcaggcagcactggctaagcccaggtatggtaaatgggcagggggacagggacacggtagggtggggagggggtactcacgcggagcggcggttgaggcgggtatccttgagagcaaagatatggacagtacccttatcactggaagcgcagaggaaggaggagtcgtggctgaagttaatgctagaagacagatcagcagtgatgcccacatgtcatgtggtatggggtcaccagcccaccatgcataccctgtgctcaccagtagagggtggcagggtcagtgcctcggcgcagctccaccagtttctccttggattgtgtgtcaaagaggcgaataagggtacccttctgggaggctgaggccactacagtgcctggctggtttagagacacacaggctatgtcactctgatgtgcattgatcgtgaatggagcagacgaggtgccaggctttgtgctcgccaggtcctggggtaggagggaggagtctgaggttggggtggtatggagggaaggggccaagagtccacaaggaagccagtccaccaacctacccacccttgtccactggacggctcaccacaagttgcagactcccacacttgtgtcccgggaacactagcagttgcttctccaggctggggcagaggtcacagagccctagggtgtgaagatggggggtggggtgggcggctgaagaggaggcagcatctcagaatggacagagctggatgaggaccagacttcaaccctccacgataagcttaacccgaagaaccctgagggggctcagctcagctgcacgccccgccagctaggcagattccattccttgctctgcagctgtggaatctagtaagctgctatcacagccccagaagctcagggatccctgacacacccacccatgtcctcacgaggtgtttttgctctgccactggggtacccaggggtggggcaggtccggaggtggggagaactggctgagggctggaaagatggagaggctatgagtgtgagcatctccctgcctctttccccatttctctgtgtgtgagtgccccttcctttctttcctcatctctgcccctctgccccatccactgtttcatgcccttacacctgtgtatctgagccctctcacccttggggttgtcccgggtatcaaactcaaacagctttcggggattgtcggggaaggagtacacatagatgcggttcttcagcacgatcacgatcctgtgggtatcacacaacacaggatggccgtgagggggtggcgggatgcccagggaggactatccctctcacttactgtggggacctcctacctcccaccccggtcctcctcaggctcacttgtcatggcgcatgcgcacagaaagcactggcttggtgaaggtgaactccagcaccagcttctccttggagtccttgccctcccgggcatcgtcccagatcagcactgctgggcaggtgggtgggttgtcggggccaaggtttagggtaaggggcagccctggtgacacaggatccacccctgcttcccagggacctcaacctacttgcttagcctttcaataaacaaccagtgagatcctcgcacagcacgagcacttgtggatatgatccctgagaggagtgttctagactgttacactcatctacagatgaggaaactgaggttcaaagtggttgagtgtctggccaaggacctcaaagctcatcagcaaccaaacagggactcacactcaggcctgtaacttcccctcggtaactatttctgcctccagggtcctagtccatgcaccctggagatttccgtgaggaatcctagggctctgtgactcacctagggcaactcctgccttgtccagatgggatcatcaagaaaaacccttaaagtaagatggcacttgaggctcaagccaagggggtattgggaagacggctccaagattttaaaacctattgcttgtgtgaccttggatgagtcacttaactgcactgggcctcagtttcctcatcggtaaagatggggataatgatccttcctaccccatagagttactgtgaggattaaatgagttaataaacgtaaagtgcttagggcagttccaggctcacagtaagtgctctagggcatggcacacaggaggcactcaatcagaatttttaaaatgaaaacaaagcaccaagcttctcaagctataagatccatgacttccaagctgtaggcctcctctctgtgtgactctgaagtactctgacgtcttcatctgccagtaccttggggtgcctgtgggaggccaggaatccgagaaatctgggccaaagggcaggatgagggcacttacctgagatctctgagaacttgggactactaccaccgcccaccaaggccagaaggttggagcggtgcagcatctccaccaagcccatgctgcccacctgctcgtggtctggacagggaccagggtgtcagtggaggtgggagccaatgcccagcccagctcttctgcccattgcccctcccctgccaacagctcacccagatgccccttctccatcaagggctccacgttgtagatgcgcacacctgtctccatggcgcagcaaaagcagcctgggggatggaaggaatccagactgccttaaagaatgcccaggtaggaagctgggggcccatggcccacttctgacccctcttttcctcgcttcctcccacaagggtacaggcccaatcctctctcactttggtcttggttgaaacgcaggctggtcactcctcgaagtggctgttgagtcatggtgcaggattgttcctctgcatacaaatgggataaagatgagaagagtcctggaatctcccctccaagttctgcctcacctgatttcctcctcctactctgctaactactgactctggagtgactgcaaaaaagataaaaacaggccaggcgtggtggcttatgcctgtaatcccagcactttgggaggccaaggcgggtggatcacctgaggtcaggagtttgagatcagcctggctaacatggtgaaatcccgtctctaataaaaatacaaaagttagccgggtgtggtggggggcacctataatcccagctactcaggaggctgaggcaggagaattgcttgaacccgagaggctgagatggcagtgagccgaaatcgagccattgcattccagcctgggtgacagagcgagactccgtctcggggggaagaaaaagataaaaacagagagtcccagggtctctgctctaagctcccaagatcccaaacaacatggccaggaaccctccttctttcaggtttggcaagctccaggcccacactgacgtggaccccacacctcctctttacatgctggccctcactgacttgtcaggaagtaatgtgatagggggtgcccccgtgatatctcctccccaccgccagccaatcttgatcccaatgccagacatggcctggaaccactcccaacccatttctcatcttcaaacctgacctagcaccggactctctcaataaatagacaaaagtgggctaggagatgcacttcttgtacctccctgacttggccctgggactgctatgcttggtctgccatccccaggaactcctctgctcatacccttctaactgtaccccaacctatttgaccaccccagagtcctctcacacctttccccctcaaccggcttccccaaactccttcaggatgcctaccttgggatgaccccttctcatgccttggtaactacccttcagggccagcctagacattcccttagattggcttatgccctggggactctaccctaggattccccctagcactctaaattttccacccctgggacatctccttccttgtgttctgctgtccttgactacaacataacctggcctggacccaaccccaggaaccccccccatcctcctaagattccccctctagacccctatccaagaccccgccccagggcacccttgccttctaagacccttgcccaaaacaaaccacccaaaactcctacctaggagaacctcaacccctaagatgcctgcgcagtcccctactaagattactgccatagagcccccaacttcccttcaaatcctcaactccccaataactctggccagacatactccctcccccatcctccaagagtccaaatctccttcctttctttcagttacaccctccactggaatgcctcatgctctttctttggacagctctgccttagagttattctctggacagctccaactttcaacaccccttttttgcacctccattccaagactctgtccgggatgcctcgcccctctcccaagaccagccgcatgctccttccaacgccagcacccactcaagacctctgccttagacccctactcgaaagacttccagcctcccccagacccaaccaaccctgggatcgtgctccagcttcctgccgccttcaccggcctgacctccgcgtgtccctgacccgggccccagctgtcggtgccgcccgcggcccggttttctgacctcccgggccttggagcccggctcgggtgtttacatcaggccctacttccgggggagggagcctgtcgcaggaaatgactcaccccagctggaaaaaggcggccaccgccttcctcgcctagttcccgggtcttcggagcatcgcgagtgacagtggggttctccggggagggcgcggggagcggaggaaggttggctgggggaccggaggcgaagggggttcctcaaggccgagactgtctgagggaacccggaagggtggggagagagagcgtgccttgcccccagcaaagcgaaaccggccaagccctcagccccttggtcacccacaatgggggagtaaaccttccctgctaacaagacgcggacctccgcggcggccgagagtagccgcaccggttcgcaacacacagtcctcccaggcttccagaggggcggcgctgggggttacaggcgggggcggacctggagaccttgaaagtggagaaacctccttggctccgagaagccaaggaacagatttcgctttctttctccccaccctgtccccccaaccccgccagctctgagttttgtcttttgtgttttgtttagttttgttttctgagacagagtctcgctctgtctcccaggctggagtgcagtggcgcgatctcggctcactgcaacctccgcctcccgggttcaaacggttatcctgcctcagcctccggagtagctgggactgcaggcgtgcgccaccacgcccatctaatttttgtatttttagtagagacggggtttcaccatgttggtcaggctggtctcgaactcttgacctcaggttatccacccacctcggcctcccaaagtgctgggattacaggcttaagctaccacgcccggcctctgcttttatttttacaaaatacaaaatagctttttgatagtaaaaggtatgaatgctttgggttaaaaaaaaaaaaaaaagaggtcctacctatgataaagcttttaaaaaaaggccccaaattatatgcatactggaaggaattttttttttttttttttttttgattaacagagtttggctctttttgcccaggctggagtgcaattagcgcgatcttggctcaccacaacctccgcctcccgggttcaagggattcttctgcctcagcctccccagcctcccaagtagctgggattacaggcatgtgccaccacgcccagctaattttgtatttttagtagagaccgggtttctccctgttgatcagtctggtcttgaactcctgacctcaggtgatccgcctgcctcggccccccaaagtgttgggattacaggcgtgagccaccgcgcccggctggaaggatttttaattaaactttacattaagaaataataaataggctgggcgcggtggctcacgcctgtaatcccagcactttgggaggccgaagcaggcagatcatgaggtcaggagttcgagatcagcctggccagcatggtgaaaccccctctctactaaaaatacaaaaagttagccaggcatggtggtgcgtgcctgtagtcccagctactcgggaggctgaggcaggagaatcacttgaagccaggaggaggaggttgcagtgagcagagatcgcaccactgcactccagcctgggtaatagagtgagactctgtctcgaaaaaaaaaaaaaaagccgggcgtggtgacacgcgcctgtaatcctagctactggggaggctgaggcaggagaaccacttaaacctaggaggcggaggttgcagcaagcccagatcctgccattgcactccagcctgggagacgagcgaaattcccgtctcaaaaaaaaagggctgggcatggtggtgcatgcctgtaatcccagcaatttgggaggccgaggcaggtggattgcctgagctcaggggtttgagaccaccctgggtaacacggtgaaacctcctctctactaaaatacaaaaaattagccgggcgtggtggcgggcacctgtaagtcccctacttgggaggctgaggcaggagaatcattggaacccagaaggcagaggttgcagtgagccaagatcgcgccactgcactccagcctgggcaacagagggaaaccctgtctccaaaaaaaaaaaaaaaaaaaagaatattcttgaaaaaaaagaaatatgctttttgcagtggcagtatcatagccaatgaggtttagccaaggtgtggatattgctaattggaaacttcccaataccccgccccgaagacttgcaatatagtcggcattggcaatttttgacagtctatgaagactgaatattaaagaaaaaatacagagaaatctcatacttttaatacaatcagggtttcacattgatgaaatcccccctttttttgaagtattgttttgatgcttctgttttttcatatattaatatataagaacatctttttaactcatcctttttaactggttcatgatattatgtagcattgttcagcccttccccaactgatggctgcctaggttgtttcagatactgtgtcgtcaattcccatgtatatatttacttgtgaattttggccctatatactccccttggcatgattccattactgtgctcctcaacaaggccaatcatctggctttcttcagactccacttcctcatgtcccagaccatattcaactcaattcaatttggtgtttgtcactcctgtgtctttgggactgctcttaaccagaccactgatgaataataatcttgccaaaccagcaatcacttctctgccctctcctgtgactttctagtgaaacccacaatttcttcctctcactctcttggtttttctttttctttctttctttttttttaagatggagtctcactctgtcacctaggctggactgcagtggcacgatctcggctcactgcaacctctgcttcctgggttcaagtgattctcctgccttagcctcctgagtaactgagattacaggcatgcaccaccacgcccagctaatttttttttttttttttgagacggagtctcgctctgtcatccaagctggagtgcagtggggcgatctcggttaactgcaacctccgcctcccgggttcaagcgattctcctgcctcaggctcccaagtagctgggattataggcatgcaccaccacgcccggctaatttttgtatttttagtagagacggggtttcaccatgttggtcaggctggtctcgaactcctgacctcgtgatccgcccgccttggcctcccaaagtgctgggattacaggcgtgagccaccgcgcccagcctaatttttgtatttttagtagagatgaggtttcaccatattggccaggctggtctggaactcctgacctcgtgatccacccatctcggcctcccaaagtgctgggattacaggcttgagctaccacgcccggcctctcgttttttttttttttttttttttctccatctctggctactcctccacttgtatcaaacttccaaatattagaatatccttgggtataatcctgtctgatcctctcttcctaagtgacttcctcttctcctgtagccttaattattgcaaatatttggaagatcctctaggccttcagcttagacctttctctggaacaccagactcaaacgtactgtaatgacctgtttgacattcatgtgggtgtcacatactgcttatccatccaaacagatttgttctatttcctttgctcagatgctcccccactgtctccttcatctcagccaatggcatcacaatacagtttgtggccaggcgtggtggctcacgcctgtaatctcagcacttttgggaagctgaggtgggaggattccttgaggctaggagtttgagaccagtctgggcaagtccctgtctctacaagaaaaaaggtgtcatgcactctcagtcaaagtggaataacagggaccaactttgtcctctcacaggaaacaaccaactttgccccccacaaaaaaaccaaaatacatgaaacaatgatttttttttttttttgacggagtctcactctgttgcccaggcacaatctcacaatggcaagatctctgctcactgcaacctctgcctcccaggttcaagtgattctcctgcctcagcctcctgagtagctggggttacgggcacctgccatcatgcctggctaatttttatatttttagtagagatggggtttcaccatgtaggccgggctggtcttgaactcctgacctcaggtaatctgcccgcctcggcctcctaaagtgctgagattacaggtgtgagccaccgcgcccggctgaaacaatgatttttaagacattagacatcaggcaccaaaggacagtgatccctgaaagatgggaaacaacgtgagcactacaactgtcccagcacactgcctggagagcttccatgctatggcactggaacgggaaactgaggcagcgcctggtggactccctaagttgaggtggtccagagagacaagggcagctggagttaaaaggacagaatgtcagcagagaggagcacagagaatcacagagatctgcagagggtcccccttcagtatttagcggagtgcttatcaacacatgcatatgaggcagctacctaaggccaggaaaagaaccatccaaatggattggagggaacaggtcctgacactcacatggagcttctgaaaatagtgcctgcacccaccaaccagactggaaaactcataattcacagggcatagagtacacaggaatgtcttgtctcagttgtggggagtaactagccctagacttagtattgctccaggctcactttacacatcataaaagaagaccctaaaagatccttaggaataacaaagattgataagaattaaaaaagacccagctcctaaaaaggtaaagttgacaatgtctgttatccaaacaaagattaccaggcataaaaagaagcaggaggctgggtgcagtggctcatgcctgtaatcccagcactttgggaggcggaaggtgagcagattgcttgagcccaggagttggagaagagcctgggaaacatggtgaaaccctgtctctacaaataattttaaaagttagctgggagtgatggcgtgtgcctctagtcccagctactcaggaggctgaggtgggaggattgcttgggcccaggaggccaagattgcagtgagccatgatggggccattgcacttcagcctgggtgacaaagagtgagactctgtctctaaaaataaatacataaataaaatggacaatattccaatgacctagtaatctgtggaaagttggatgaaagtttaggtattccagacttgttcaaattaattgtatctatatctcagagaaaatcttcctcaaaacatgattttttttaattggggagacagcttccaatgtaaactgaaagtgcacacccaaaacacaaatatctaaggtaaaaattactctgctcagacccagttgagccagctttaatattagtgtccctcctttattaccacaaaggggtcccaatccagaccccaagagaaggttatttgagatggagtttcactcttgttgctcaggttggagtgcaatggcgtgatctcggctcacttcaacctctgcctcctgggttcaagcgattctcctgcctcagcctcctgagtagctgggattacaggtgcgtgccaccatgcccggctaatttttgtatttttagtagagacggggtttcaccatgttggtcaggttggtctcgaactcctgacctcaagtgatccacccacctgggcctcccaaagtgctgggattacaggcatgaaccaccgtgcctggcccaacatctctttaaacaactgcccctgggcatgggtgggtgggtggaggatgtgactgagctgagatgctcctttctctctgggactgataaattttgcatactttacatagctcagactgcccttgggctatttgtcttttctcttttttttttccccgaggcggagtcttgctctgtcgcccaggctggagtgcagtggcacaatctccgctcactgcagcctccgtctcctgggttcaagtgattcttccgcttcagcctcctgagtagtggggattacaggcgtgcaccaccacgggggctagtttttgtatttttagtagagatggggtttcactgtgtcggccaggctggtctggaactcctgatctcaaatgatctgcccgccttggcctcccaaaatgctgggattacaggcgtgagccactgtgcccagactcctttttttcttttttagagacagggtctggatcctcctgtctctgcctcccaaagtgctgggattacaggcataagccaccgctcccagcctagttttattttctcagtgcaaatttaggagccatcagtatactgtttttgtttttttgttttttgttttttttttttaaagataaagaaggctgggcatggtggcctacacctgtaatcccagcactttaggaggccaaggcaggcagatcacctaaggtcaggagttcaagaccagcctggacgacatggtgaaagcccgcctttactaaaaatacaaaattagccgggcatggtggtgcatgcctgtaatcccagctacttgggaggctgaggcacgagaatctcttcaacccgggaggcagaggtttgcagtgagctgatatcgcgccactgcactccagcctgggcaacaagagcaaaactgcgtctcaaaaaagaaaaaaaattagctgggtatggtggcacatgcctgtaatcccagctactcgggaggctgaggcaggagaatcacttgaacccgggaggtggaggttgcagtgagtcgagattgtgccactttggtccagcttggacaacagagcaagaccatatcaaataaataaataaataaaatgaaatgaaagagatcacctagcaagtgatgtaaataaagaagaggttctaggactaagacgtgggacattgctaagatatagggctcaggggaaccaggaggaactagcaagactgaataggagaagccatcaaggcaggagcagagccaagagaagattccagaaagtcaaaggaaaaagcatttcaaggacaggtgcggtggctcacgcctgtaatctgagcactttgggaggccaaggtgggaagactgcttgagcagttgctgagattgttttagccggaggttgaggcttcagtgagccatgattgtgccactgcactccaatctgggcaacagagcgagacccagtctcaaaatttttaaaaacacaaaaaatcagtggcagttgtttaacatcatagctggttgagatggtgataagagctggagtaaacaagcaacagaccaaaaagcatgaaaggaaaagctggggaatgagatgtctatgaaaagttctgacacactgctggatatctggaatgccatatgcatgcccatgcatagggctgtgagcatgcccaagaaagaaccaagaaaaggccgggtgtggtggctcatgcctgtaatcccagcactttcggagggtgaggcgggtggatcacttgaggtcaggagtttgagaccagcctggccaacgtggtgaaatcctgtctctactaaaaatacaaaaaaagttagctgggcgtggtggcgtgtgcctgtaataccaggtactcgggaggctgaggcaggagaatcgcttgaatcctggagatggaggttgcagtgagctgacatcacaccattgcactccagcctgggcaacaagagcaaaactccgtctcaacaacaacaacaacgaagagaaccaagaaggccttaagctcttatttgtgggggaccttcaggctttgggcaaggaaaaagtgaaggctaaggcacagttgtgaactacctgagggagtgttctaggtattctccaacatacatggacacacattaggcaaatgctggaagaagtaatggttcaaggcatttaagggaacctttgcctaaccgttatctggtcagtaagctaatgaagcagggccttcagtggccacacacaacaaagaatacacactttatagaattagttcagaaaagttgctaaacaggctcatagtagctcatgcctttgggaggctgacatgggaagatggcttgaacccaggagtttgaggtgcagtaagctatgatcatgcactacaatccagcctagacaacaagagggagaccttatctcagaaacaaacaaacaaacaaaaagaagtcactaaacagcagtgataataaaaacaaacagcagccacaacaaaccctgggaaggagacaatctgaatttcagagttgccacattatttaaaatgtccagattaaaaaatgcaaagaaactagaaagtaggccagacacagtggctcacgcttgtaatctcagcactttgggaggccaaggtgggtggatcacctgaggtcaggagttcgagaccagcctggccaacatggtgaaactctgtctctactaaaaatacaaaaattagctgggcgtggtggcgcacgcctgtaatcccagctactcaagaggctgaggtggcagaatcacttgaactcaggaggcggaagctgcagtgaggcaagatcatgccactgcactccagcctgggtgacagagggaggctccatctcaaaaaataaataaactagaaagcatagcccatacacaggaaagaaaaaaagaagaaaaaaaccggtaaataaaaacttccactgaggaagctcagatgttggaattactagacaaagttttttttgagacagagtctcactctgttacccaggctggagtgcagtggtgtgatctcagctcactacaacctcagcctcctgggttcaagcgattcttgtgcctctgcctcctacgtagctggaattacaggcatgtgccaccacgccccactaattattgtatttttagtacacacagagtttcgccatgttggccaggcaatatagtgagaccccatttttacaaaaaagtagctggccatggtggtgcatgcctgtagtcccacctactcaggaggctatggcaggaagatcgcttgagcctaggaggtggaggttgcaatgagctgagatcgggccactgcattccagcctgggtgacagagcaaaaccttatctcaaaaaaaaaaaaaaaaaagaaaagaagagaaaaaaagaagtactgtacttatacgtgtggtacaacatggatgaaccttgaaaatattatgctatatgaaataagccagacacaataggccacatatttttatgattaatttatatgaaaaaccaagataggcaacttcatagagacagaaaatacattcgtggtttttaggagctaaaggctaggggatgggtggaatagtgactggtaatggctatggggtttcctttagaggtaatgaaataaaggaataaaggtttttttttttgagacaggagtctgactctgtccagcctggagtgcagtggtgtgaacttggctcactgcaacctctgcctcccaggttcaagcgattcacctgcctcagccttccgagtaactgggattacaggcgcctgccaccgcgcccggctatattatgtatttctagtagaaacgggatttcatcatgttggccaggctggtccggaactcctgacctcaggtgatccacccggctgtgcctcccaaagtgttgggaatacagacatggccaccacacccggcccaaaataaagcttcttgaattagatagtgttgatgtctgcacaatcttgtgaatgtactaaaaaccactgaattgcacactttgaagaggttggttctatgatatgtacatcttaccttacaactataagaaaaggaatgacctattgaaacatggaacaaacctggtgaatctccaataatttttttttttgagatggagttttttgctcttgtcacccaggctggagcaatggcacgatctcagctcactgcaacctccgcctcctgggttcaagcaattctcctgcctcagcctcccaagtggctgggactacaggcacccgccaccatgcccagctaatttttatatttttaacatgggcagagtttcaccacattggctaggctggtgttgaactcctgacctcaggtgattcacctgcttcggcctctcaaagtgctgggattacaggtgtgagccaccgtaatccaggccttttttttttttgagacggagtctcgctctgtcacccacactgaagtgcggtggcgcgatctcggctcactgcaacctctgcctcccaggttcacgccattctcctgccgcagcctcccaagtggcgcccgccaccatgcccagctaacttttttttgtatttttagtagaggcggggtttcaccgtgttagccaggatagcctcaatctcctgacctcgtgatccgcccgcctcggcctcccaaagtgctggggttataggtgtgagccactgcgcccggcttccaataacttttatagagtgaaagaacttagagagagctagtcttggtggctcatgcttgtaattccagcactttgggaggctgaggcgggtggatcacttgagctcaggagttcaagaccagcctggccaacatggcaaaaccccatctctaccaaaaatacaaaaattagctgggcgtgatggtgcacgtctgtaatcccagctacttcagaggctgaggcaagagaatcacttgaaaccgggaggtggaggttgcagtgagccgagatcgcaccactgcactccagcctgggcgacagagcgagactccgtctcaaaaataaagaaaagaaagaaggaattggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgaggttgcgccactgcagtccgcagtccgacctgggcgacagagcgagactccgtctcaaaaaaaaaaaaaaaaaaaaaaaaaaaaaagaaggaatttagaagagttcatactaagatgcacttatataaaactcttaaaaaggcaaaatatgccaggcgcggtggctcacgcctgtaatcccagcactttgggaggctgaggcgggtggatcacgaggtcagtagatcgagaccatcctggctaacacggtgaaaccccgtctctacaaaaaattagccaggcgtggtggcacttgcctgtagtcccagctactcgggaggctgaggcaggagaatcgcttgaacccgggaggcggaggttgcagtgagcgagaccacgccattgcactccagcctgggcaacagagcaacactccatctcaaaaaaaaaaaaaaaaaaaaaaaaaaggcaaaatataacaaagtatattttgtacactttgttatattttgtatactttgttatattttgtatgctatagtaacaaagcagatccgtggttgcttggggatgaggtggggcagttaggaagggaattacaaaggggcatgaggaaacttggagatgatgatatgtccactatcttgattatggtgatggtttcatgagtgtatgcatatgttatttttttcaaaacaaatacctaacacttctgtttcttggaccaattttttttttaacttgccctgcccccaccacctgcttggaccaaaatataatacctatttatgtcctaaaaaaatagtagcagtttagaaaatcgacaacacatagatagaaaaaaaaattgttaaataactacaattgcttattaatggatgcatgtttgttagactctgcacaccttcccaaaccttaatcagattgtctgatatcacctaaatcactttatccatgctgatttttgtcaggtgtttgctttttatcacagaaactgctgtaaacccagctttgcaaaaagatgtcattgaaagaaaagtagttcaatgtaactttgaaactttgaactcccttgaatagtttatgaggtatctgacatgttgagtacccatatatttccctcaaacaatttaaagcatcttacagcgtccctgagaattcactatggcactctgaggtgcctcaacacagtttgggaactgcaatcctaactcacgcaggtctgtgtttcctcattctgtttcttttcacttagtattatggtttttttgttttgttttttagagggagtctctgtcacccaggctggagttcagtggcgccatctcggctcactgcaacctccgcctcctgggttcaagccattctcctgcctcagcctcccaagtagctgggattacaggtgcccaccaccatgcctggctaatttttgtattagagacggggtttcaccatgttggccaggatggtctcgatctgacctcggcctcccaaagtgctgggattacaggtgtgagccactgtgcctggccagtattatgtttttaagctggatactttgttttcttttaatagagatggggtcttgaggtctcactatgttgcccaggctatattttttttgagacggaactttgctcttgtcacccaggctggagtgcaatggcacgacctcagctcactgcaacctccacctcctgggttcaagcaattctcttccctgggattacaggcttgagccgctgagcccggccagcccaggctaatcttgaaccactgggctcaagtaatcttcctgtctcagtcttccagagtgctaggattacaagcgtgagccaccacaatcagccttcttttttttttttttttttaatgagtcagggtctccctctgtcacccacactggagtgcagtggtgtgatcatagttcactgcagcctgcagcctcgaactcctgggctcaggcaatactcccacttcagcctcccaagtagctgggactacaggcacacttcaccatgcccagctttttaaaacatattttttgtgaagatgcggtctcattatgttggccaggctggtctcaaactgccggactcaagtgattctcccaccttgttccccaaagtgctgggattacaggtgtgacccaccttgcctggcccggggtgtcttttttttctgagatggagtctcactctatcgcccaagctggagtgcagtggtgtgatctcagctcactgcaacctccacctcctgggttcaagcgattctcctgcctcagcatccccagtagctggaattacaggcacacaccaccatgcctggctattttctgtatttttagtagacacaaggtttcaccatgttggccaggctggtctcatagggtgtctttaactagcatggaacccacaaggtccactcattcatttttgtattacctcccaggctcagcatggtgcctgaacctctataaggaggcaatgtgtgttaagagagacaggaggggtcaggtgcggtggctcacacctgtaatcccagcactatgggaggccaaggcaggcagatcacttgaggccaggagttcgagaccagcctggccaacatggcaaaatcccgtctttactaaaattgcaaaaattagccatgcgtggtggtgtacgcctgtaatcccagctatttaggaggctgagacatgagaattgcttgaacccgggagtttgaggttgcagtgagctgagatcgccccactgcactccagcctgggtgaaaaaataagactgtttcaaagaaaaaaaatttttttttttgtagagacggggtttccccacgttgcccaggctataactgtactttaaaagacacaatactctagagatgtcattacagttagtagattattatcttaattgaccctaaattcgctattttggagctaagcaaccaattacggcctggtggtatattcacctgctccttagatggaggttctgtgaaggcagcagctctgtccatgttgtttactgtagggctgaacactgaccttgagacatagttggcactcaaaattatatgttgaatgacagaattttgattaggtggatctaacgcatttgaaataattcatagggctgggcacggtggctcaagcctgcaatcccagcactttgggaggtggaggcaggcagatcgcctgaggtcaggtgtgcaagaccagcttggccccagcctccctagtagctgggattacaggcatgcaccaccacgcctggctaattttgtatttttagtagagatggagtttctccatgttggtcaggctggtctcaaactcccgacctcaggtgatctgcctgccttggcctcccaaagtgctgggattataggcatgagccaccgagcccgaccatcctggacatctcttaacccagctttccctctgcaaagggagcatgcatttcagtgaaagtttagaagaattacagtgatatcactttcatgaatcaaaattggctacttgacttcagtaatttgtgaaaattactgttgcggctgggcatggtgcctcacacctgtaatcccagcactttgggaggacaaggtgggaggattgcttgagcccaggagttcgagactggcctgagcaacatggcaaaattccatctctacagaaaatacaggctgggcacggtggctcacacctgtaatcccagaactttgggaggccaaggcgggcgagcctcctgagtagctgagactataggttcacaccactacatccggctaattttttttttttgagatggagtcttgctctgttgtccaggctggagtgcagtggcacgatctcggctcactgcaacttcttcctcccaggttcacgccattctcctgcctcagcctcccgagtagctgggactacaggcgcccgccaccacgcccagctaattttttgtatttttagtagagacggggtttcaccatgttagccaggatggtctcgatctcctgacctcatgatcggcccaccttggcctccaaaagtgctgggattacaggtgtgagccaccgtgcccggcctttttttttttttttttttttttttgaggcggcatctcgctgtcacccaggctagagtgcaatggcgtgatctgggctcactgcaacctccgcctcccgggttcaagcaattctctgcctcagcctcctgagtagctagaattacaggcgccagctgccaagcctggctattgtttttgtatttttttttttagtagagatagggtttcaataagttggccaggctggtcttgaattcctgaccttgtgatccacccacctcggcctcccaaagtgctgggattacaggcgtgagccaccctgcccggccaagttttacattattaagctatccatgttctcttgggaactgaactttttttcctcttgatgctctggatttgacattgcacttgactttttatgtagtaactgacatgtgccagagttggcatcttcccccaagtccaagcatcatgagtaactcttgcttatctctctctctctcttttttgagacaggttttgctgtcacctaggccgcagtgcagtggcgtaatcatggctcattgcagtctcaacctcctgagctcactcaatcctcccacctcagcctcccatgtagctgagactacaggcacgcaccaccacacccagctaaatttgtttatttttgtagagactagatctcactatgttgcccaggctggtcttgaactctggagctcaagcgatcctcctgtctcagcctcccaaaatgttggcattataggcgtgagccactgcaccctgccttgcttatctttatagattcaaatggtaggcatttcccatcacctaattcctttttttgttattgttgaatagggtcttgctctgttgcccaggctagagggcagtggcccaatcacagctcactgcagcttcaatcttttggactcaagtaatcctcctgcctcagcctcacaaagtgctgggattacaggcatgagccaccaggcttggcaagtgatgatattttttatttttattttttgagactgagtttcgctctgtcgccaggctggagtgcagtggcacaatatcggctcactacaacctccgcttcctgggttcaagcgattctcctgcctcagcctctcaagtagctgggactacaggtgcacaccaccatgctcggctaataagagatggggttccaccatgttggccaggatggtctccatctcttgacctcgtgatccgcccacctcggtctcccaatgtgctgggattacaggtgtgagttactgcgcctggccagcaaatgatgaaattcttataatttaaatggctacagacttaaaaggcaagctatatacattgaagcacttttttttttagcatttgtacttttcaaatagacccattcttttattaataagctaaagattttcttttcctcccccatcttctttatttgtaaatacttttgggtgtgtttcttttagttaagtatgcacaacagataagaaagggtgtgtttctgttatttatttgagatggagtttcacttttgtcgcccaggcgcccaccactagccccagctaattgtttttttttttttttttgagacagagtctcgctctgtcgccaggctggagtgtggtggcgtgatctgggctcactgtagccttcacctcctggttttaagcgattctcctgtctcagcctcccgagtagctgggactacaggcacgtgccaccatgcccagctcattttttgtatttttagtagagatggggtttcacaatgttggttaggatggtcttgaactcctgacctcaggtgatctgcccgcctcggcctcccaaagtgctgggattacaggcatgagccaccgcgcctggcctcccccagctaatttttgtattattattattattatttttttttttgagatggaattttgctcctgttgcccaggctggagtacaatggcgcaatctcggctcactgcaacctctgcctcccaggttcaagcgattctcctgtctcggcctccagagtagttgggattacaggcgttagccaccacacctggcttattttttgtatttttagtagagatggggtttcaccatgttggtcaggccggtcttgaactcctgacctcaggtgatccacctgccttggcctcccaaagtgctgggattacaggcacgagccactgtgcccggcctatttatttattttttgagatgaggtctctgttgcccaggctggagtgccgtggtgtgatcatggctcactgcggcctctaattgcaaggcttaagtgatcctcccacatcagcctcctgagtagctgggaccacaagtgtgtaccaccaaactgggctaattttttgtaatttttgtagagacggtgtctcacattgcccagactggtctcaaactcctggcctcaagtactctctctttaaaaaagataatactgcagggcgtggaggctcatgcctgtaatcccagcactttgggaggctgaggtgggcggatcacttgaggtcaggagtttgagaccagcctgaccaacatggcaaaacctggtctctactaaaaatacaaaaattagccaggagtggtggcgagcacctgtaaatcccatctactcgggaggctaaggtgcgggaattgcttgaacctgggaggcggaggttgcagtgagtcaagaccgtgccactaaactccagcctggacaacagaaggagaacctatcttaaaaaaaaaagaaaaaaaaaggtaataaaggctgggtgcagtggctcatgcctgtaattccagcactttgggagtctgaggcaggaggattgcctgaacgcagaaatttgagaccagcagggcaacattgtgagacctcatctctacaaaaagtaaaaaattagccaggtgtagcgtggcgcacctgtactccaagctacttggggggctgaggtgggaggatggcttgagcacaggctgtccagactgcagtgagccatgacttcaccattatactccagcctgggtgacaaagaaataccctgtctctacccccccaccaaaaaatgagttaatatagcttattgtatgtttggttatactgtaatctttagaacaaaatcccaaacaaaaacaatgcacccctcacttcctatggcatctgagtggcgaaactgaagtatatacaaagtattatatgaaacggaagtatatacaaagtattatacaaaagtgaagtatacatgttacaaagccagccactctcagaaacatccagaggaggggcctggcacagtggctcatgccagtaatcgcagcactttgggaggcccaggtgggtggattacctgaggtcaggtgtttgagaccatcctggccaacatggtgaaaccccatccctactaaaaatacaaaaattagctgggcgtggtggtgcgtgcctgtagtcccagctactcgggaagctgaggcaggagaatcgcttgaacccgggaggcagaggttgcagtgagccgagatcacaccactgcactcctgcatggcaacagagtgagactccatttcaaaaaaaaaaaatccagaggtgactaattgcccggacttcaactgaacctttgaagagtgctacccagtactccagttcccacacactcacagttaaaatagcaacctttttcctcattcctgagaaaagagggataaaataacaatctaagagaaaaggaaagaacaatgtttctggggcgggcgtagtggcttatgcctgtaatcccagcactttgggaggctgaggcaggcggatcacgaggtcaggagatcgagaccatcctggctaacacggtgaaaccctgtctctactaaaaatacaaaaaattaaccgggcgtggtggcgggcgcctgtagtcccagctactcaggaggctgaggcaggagaatggcgtgaacccggaaggtggagcttgcagtgagtcgagatcgcgccactgcactctagcctgggcgacagagcgagactatgtctcaaaaaaaaaaacaaaaacaaaaacaaaaaaaaacacacagtgtttcttgggaccagacctgatatcaacgttgtttcttgggaccagacctgatatcaacgttgtttcttgggaccagacctgatatcaaggttggctgttttcagcagtggaggcagcactacgctattggagtttctaagctaattaagggaattttttcccacttagtgaaagctggggcctcagggctcaggcttcctaacattttgggcacccagttaaaagatcaacagtcccctgtcccttcagcatgtgactcaccccagggcaatgaactgggcccacggctccatctgcatctatatccctgtaaatcatggatttatacatattggtgcatacgtttataatgcttgcaatatatacttccatttcaacttacatatatataaaatgtaacaatttcttttctttctttttttttttttttgagacgtagtttcgctctgtcgcccaggctggagtgcactggcgcgatctcggctcactgcaagctccgcctcccgggttcacgccatcctcctgcctcagcctcctgagtagctgggactacaggcgcccgtcaccacgcccggctgattttttgtatttttttagtagagacggggtttcactgtgttagccaggatggtctcgatctcctgacctcgtgatccacctgcctcggcctcccaaagtgctgggattacaggcgtgagccaccgcgcccggccaaaatgtaacaatttcaacctgtaaaaagataagtggtcaccttacctatgatgtggattaaataagacgtgtcaacgcagccatcctgccccatccgaccagaccttaatgctccaaaaccatcagtttgcgcctggaaaactggggaaagtgtttattcccttacacaggcttcgccaaaggccctgacacttagggctttttcactgctgcaaacgttggaccggcttgtgagaaggagtacagttaatctaactttggtatactgtatccagagaccacagagggctcgctctgcgatttatggtgcgaggaagaccagacacccgctgtgcccgtcctactcctgcagatcaaactcaaagccacactttccggagtgagaaacgggacagtaaatgaacgcaggaaccacggtgcgcaggcacagaaccccgctgggtttgctacgaaggttgaggtggaagcgcccagcgcaccaggcgccacggcccggtgtgtgacctcactaacctccaccagcgcgcaccctgtcctgccccttcacgggcgaacaaccccacacgaggcagtggtgtgggagcc

SEQ ID NO: 2320 - DNA, 5474 bp, Homo sapiens
aagccgtaaatgccattaagggccttttattcgtattcatcacatcggagatcatctcttcctaggaagcttttaaaaaatccccaggttggattagggcactccctctgggtccctggcaatttcctccaggttagggatcccaaggggtcgctgccttcctgggtctctggcctggcccttggggcacacagtcatcaagaagtgctggggggaagtgagctctttatttagacatagctctgctgagtggaaagtgggcaccagccccattaatgcttgctggctggtggcttccaagcacgccccactgccaaggctcagctctgcagttctgccactgcaggtccctagcacagcccccagggtccttaaaagtcatcatcatcacagatgtcaaggtacacgtcgaaagcctctctgttgcagtttccatcaggagtgaagacatatttgtggaaggtcccatctacgcagatggctgggggagggggggtggtaaaaggtcagaggctgccacagccacaggctccagtcctctcaggcatctcaggacctagggtctgcctccaggcctttgcccagtgctgtcccccttactgatgatgaagctgagcctcacatggccctaaaatcctttcaggtccaacctgcaggcctttgccccatgcagtacccccaaccaaggggctgttcccactcaccaatgacagagttgacgttcttggaagtattgcgaccgaaggcgcagatgcaagctgactcagcaggcacagtgaagctcgccaggctccactgagagtccacgtactgcccaatcataggccccaccttgcccacgcgagccagcctgcaggcagcactggctaagcccaggtatggtaaatgggcagggggacagggacacggtagggtggggagggggtactcacgcggagcggcggttgaggcgggtatccttgagagcaaagatatggacagtacccttatcactggaagcgcagaggaaggaggagtcgtggctgaagttaatgctagaagacagatcagcagtgatgcccacatgtcatgtggtatggggtcaccagcccaccatgcataccctgtgctcaccagtagagggtggcagggtcagtgcctcggcgcagctccaccagtttctccttggattgtgtgtcaaagaggcgaataagggtacccttctgggaggctgaggccactacagtgcctggctggtttagagacacacaggctatgtcactctgatgtgcattgatcgtgaatggagcagacgaggtgccaggctttgtgctcgccaggtcctggggtaggagggaggagtctgaggttggggtggtatggagggaaggggccaagagtccacaaggaagccagtccaccaacctacccacccttgtccactggacggctcaccacaagttgcagactcccacacttgtgtcccgggaacactagcagttgcttctccaggctggggcagaggtcacagagccctagggtgtgaagatggggggtggggtgggcggctgaagaggaggcagcatctcagaatggacagagctggatgaggaccagacttcaaccctccacgataagcttaacccgaagaaccctgagggggctcagctcagctgcacgccccgccagctaggcagattccattccttgctctgcagctgtggaatctagtaagctgctatcacagccccagaagctcagggatccctgacacacccacccatgtcctcacgaggtgtttttgctctgccactggggtacccaggggtggggcaggtccggaggtggggagaactggctgagggctggaaagatggagaggctatgagtgtgagcatctccctgcctctttccccatttctctgtgtgtgagtgccccttcctttctttcctcatctctgcccctctgccccatccactgtttcatgcccttacacctgtgtatctgagccctctcacccttggggttgtcccgggtatcaaactcaaacagctttcggggattgtcggggaaggagtacacatagatgcggttcttcagcacgatcacgatcctgtgggtatcacacaacacaggatggccgtgagggggtggcgggatgcccagggaggactatccctctcacttactgtggggacctcctacctcccaccccggtcctcctcaggctcacttgtcatggcgcatgcgcacagaaagcactggcttggtgaaggtgaactccagcaccagcttctccttggagtccttgccctcccgggcatcgtcccagatcagcactgctgggcaggtgggtgggttgtcggggccaaggtttagggtaaggggcagccctggtgacacaggatccacccctgcttcccagggacctcaacctacttgcttagcctttcaataaacaaccagtgagatcctcgcacagcacgagcacttgtggatatgatccctgagaggagtgttctagactgttacactcatctacagatgaggaaactgaggttcaaagtggttgagtgtctggccaaggacctcaaagctcatcagcaaccaaacagggactcacactcaggcctgtaacttcccctcggtaactatttctgcctccagggtcctagtccatgcaccctggagatttccgtgaggaatcctagggctctgtgactcacctagggcaactcctgccttgtccagatgggatcatcaagaaaaacccttaaagtaagatggcacttgaggctcaagccaagggggtattgggaagacggctccaagattttaaaacctattgcttgtgtgaccttggatgagtcacttaactgcactgggcctcagtttcctcatcggtaaagatggggataatgatccttcctaccccatagagttactgtgaggattaaatgagttaataaacgtaaagtgcttagggcagttccaggctcacagtaagtgctctagggcatggcacacaggaggcactcaatcagaatttttaaaatgaaaacaaagcaccaagcttctcaagctataagatccatgacttccaagctgtaggcctcctctctgtgtgactctgaagtactctgacgtcttcatctgccagtaccttggggtgcctgtgggaggccaggaatccgagaaatctgggccaaagggcaggatgagggcacttacctgagatctctgagaacttgggactactaccaccgcccaccaaggccagaaggttggagcggtgcagcatctccaccaagcccatgctgcccacctgctcgtggtctggacagggaccagggtgtcagtggaggtgggagccaatgcccagcccagctcttctgcccattgcccctcccctgccaacagctcacccagatgccccttctccatcaagggctccacgttgtagatgcgcacacctgtctccatggcgcagcaaaagcagcctgggggatggaaggaatccagactgccttaaagaatgcccaggtaggaagctgggggcccatggcccacttctgacccctcttttcctcgcttcctcccacaagggtacaggcccaatcctctctcactttggtcttggttgaaacgcaggctggtcactcctcgaagtggctgttgagtcatggtgcaggattgttcctctgcatacaaatgggataaagatgagaagagtcctggaatctcccctccaagttctgcctcacctgatttcctcctcctactctgctaactactgactctggagtgactgcaaaaaagataaaaacaggccaggcgtggtggcttatgcctgtaatcccagcactttgggaggccaaggcgggtggatcacctgaggtcaggagtttgagatcagcctggctaacatggtgaaatcccgtctctaataaaaatacaaaagttagccgggtgtggtggggggcacctataatcccagctactcaggaggctgaggcaggagaattgcttgaacccgagaggctgagatggcagtgagccgaaatcgagccattgcattccagcctgggtgacagagcgagactccgtctcggggggaagaaaaagataaaaacagagagtcccagggtctctgctctaagctcccaagatcccaaacaacatggccaggaaccctccttctttcaggtttggcaagctccaggcccacactgacgtggaccccacacctcctctttacatgctggccctcactgacttgtcaggaagtaatgtgatagggggtgcccccgtgatatctcctccccaccgccagccaatcttgatcccaatgccagacatggcctggaaccactcccaacccatttctcatcttcaaacctgacctagcaccggactctctcaataaatagacaaaagtgggctaggagatgcacttcttgtacctccctgacttggccctgggactgctatgcttggtctgccatccccaggaactcctctgctcatacccttctaactgtaccccaacctatttgaccaccccagagtcctctcacacctttccccctcaaccggcttccccaaactccttcaggatgcctaccttgggatgaccccttctcatgccttggtaactacccttcagggccagcctagacattcccttagattggcttatgccctggggactctaccctaggattccccctagcactctaaattttccacccctgggacatctccttccttgtgttctgctgtccttgactacaacataacctggcctggacccaaccccaggaaccccccccatcctcctaagattccccctctagacccctatccaagaccccgccccagggcacccttgccttctaagacccttgcccaaaacaaaccacccaaaactcctacctaggagaacctcaacccctaagatgcctgcgcagtcccctactaagattactgccatagagcccccaacttcccttcaaatcctcaactccccaataactctggccagacatactccctcccccatcctccaagagtccaaatctccttcctttctttcagttacaccctccactggaatgcctcatgctctttctttggacagctctgccttagagttattctctggacagctccaactttcaacaccccttttttgcacctccattccaagactctgtccgggatgcctcgcccctctcccaagaccagccgcatgctccttccaacgccagcacccactcaagacctctgccttagacccctactcgaaagacttccagcctcccccagacccaaccaaccctgggatcgtgctccagcttcctgccgccttcaccggcctgacctccgcgtgtccctgacccgggccccagctgtcggtgccgcccgcggcccggttttctgacctcccgggccttggagcccggctcgggtgtttacatcaggccctacttcc

SEQ ID NO: 2321 - DNA, 16750 bp, Homo sapiens
ccaaagttaaaagcgcatcaaacacgcctagcttttattattttaatcacaaacctatagacccctcagtataccctccatggggcctggccccagcaatccaaagctgacaaccttgggtgtaggtatgaggggtgggaatggaggggggagtgtctcttgataactctgaaatggggtgattcctccaaatgaagaactgggtggggaacagaggttggggtggcctagattctcagtatgcggagcaataaaaaaatcagataaacaaatgagggggtacaatatgcttttacaaccctcctccaagcttctgccttgctgggggaaggcttccagtttttcctgggctggggaggtcccaggatagccccttccttcatcctcttgccctacatgttgaaaaagaatactgaggtactggttctggtaacctgaactcagtcccccactaatacccatcaccttcccaaactgcccctcaaggaagaaggcaggactctgcccaagggtgggggcctctcactccagatataggtctggaaaattcatccatgaaatttcataatctgtccccttccccaagagcaaggttggctcagagccctcctaggttaggtcaggttggtcccaggttaaggcaggggagcttaagtaccactcctccctgcagtgtggaatgcttagatgggatgttgctgagggacaagggtggggctgtgatctccacaagcactagcggtggcctggtcctactgattctttcacacctgaaatacctgtgctgggctgttcctatagggaaggggtggggcctggctcctccattcctagaaggccaggagagttcccaggggaaggggctgggtctcatcctcacttctgttccttgcctgggcagagcagggcagggttcatggggaaggggcagagcttaaacccccagggctgggacctccattacttgactcctcttctgtgccaggacggactagactggtggttccaagacaaaggatggagcaacatcctgacatctccctttcccaggagacctggctaggacagtccctaggggacagggtcgagacctcatcctgtctccttccctcacctgggcaaggatgagtcccacaggggcaggggtgaggctgtgatccccagggggcaggccctgatctcatgtccttctccagccttctccttctgaaatacctgcactgggcggttcctttggggaaggtgcagggcctcatctgactcctcctccttgcctgattacaggggtggggcctgatcacatctcctcttcccccaggatacctgggcagggcagtctcatgggagggtgggggaaaaggcggggcctcatcctgactggtcctcctttcctgggtgggaaagtcccaggggaggggtgaggcctgatcaggactcctcttccatgctgaagctgctgcggcggctgctggccttggagacagcaggggacactgaagagagcaggggatcggaggcagcccgcagtggggacagggcaccccccgacagtcctcccaccaccccctcctcctcctccatcagaatgtcctccagccccaggtggaaggggtctcccaggtcccccaggtggtcgctgggaaagtgcaggtccagaagggcatctgagggcggtgcagggggctgctgatggggagcattctgggcaggtcccccccctacatggaacgttgctgcgcctggcctgccctcctcctcaatgtccagctgctctggcttgaggctgtcagaagccgaagtcgtggccaaggaaagcagccctggagtgggaggtactggcaggccatggatctgggcctgcagttctagttcctgtaaaaaataggggttgggtgcaggataagtagggttcagagtccctcagaggcagaggagtataaaggttgaaaagggtaggttccctgggttggaattcagcttctgctactcactagttccaaaactttaggcaaggtgcttaacatctctgaagcttcagagtcgcaaactgtaaagtgggtatataataatggcccctaggctgggcgcggtggctcacgcctgtaatcactttgggaggccgaggcaggtggatcacctgaggtcaggagttcgagaccagcttgaccaacatggagaaaccccatctctactaaaaatacaaaaattagctgggtgtggtggtgcatgcctataatcctagctactcaggaggctgagacaggagaattgcttgaacccgggaggcggaggttgcggtgagccgagattgcgccattgcactccagcctgggcaacgagcgaaactccatctcaaaaataaataaataaataaataaataaaataatggcccctatctcatagaattctgaggattgaataagttagtggatataaagctcttgtcacagtacagagcacaagataaatgctatgtacattagcaatattattatccttgttaaccaagggtgggggcctctcactccagatataggtctggaaaattcatccatgaaatttcataatctgtccccttccccaagagcaaggttggctcagagccctcctaggttaggtcaggttggtcccaggttaaggcaggggagcttaagtaccactcctccctgcagtgtggaatgcttagatgggatgttgctgagggacaagggtggggctgtgatctccacaagcactagcggtggcctggtcctactgattctttcacacctgaaatacctgtgctgggctgttcctatagggaaggggtggggcctggctcctccattcctagaaggccaggagagttcccaggggaaggggctgggtctcatcctcacttctgttccttgcctgggcagagcagggcagggttcatggggaaggggcagagcttaaacccccagggctgggacctccattacttgactcctcttctgtgccaggacggactagactggtggttccaagacaaaggatggagcaacatcctgacatctccctttcccaggagacctggctaggacagtccctaggggacagggtcgagacctcatcctgtctccttccctcacctgggcaaggatgagtcccacaggggcaggggtgaggctgtgatccccagggggcaggccctgatctcatgtccttctccagccttctccttctgaaatacctgcactgggcggttcctttggggaaggtgcagggcctcatctgactcctcctccttgcctgattacaggggtggggcctgatcacatctcctcttcccccaggatacctgggcagggcagtctcatgggagggtgggggaaaaggcggggcctcatcctgactggtcctcctttcctgggtgggaaagtcccaggggaggggtgaggcctgatcaggactcctcttccatgctgaagctgctgcggcggctgctggccttggagacagcaggggacactgaagagagcaggggatcggaggcagcccgcagtggggacagggcaccccccgacagtcctcccaccaccccctcctcctcctccatcagaatgtcctccagccccaggtggaaggggtctcccaggtcccccaggtggtcgctgggaaagtgcaggtccagaagggcatctgagggcggtgcagggggctgctgatggggagcattctgggcaggtcccccccctacatggaacgttgctgcgcctggcctgccctcctcctcaatgtccagctgctctggcttgaggctgtcagaagccgaagtcgtggccaaggaaagcagccctggagtgggaggcactggcaggccatggatctgggcctgcagttctagttcctgtaaaaaataggggttgggtgcaggataagtagggttcagagtccctcagaggcagaggagtataaaggttgaaaagggtaggttccctgggttggaattcagcttctgctactcactagttccaaaactttaggcaaggtgcttaacatctctgaagcttcagagtcgcaaactgtaaagtgggtatataataatggcccctaggctgggcgcggtggctcacgcctgtaatcactttgggaggccgaggcaggtggatcacctgaggtcaggagttcgagaccagcttgaccaacatggagaaaccccatctctactaaaaatacaaaaattagctgggtgtggtggtgcatgcctataatcctagctactcaggaggctgagacaggagaattgcttgaacccgggaggcggaggttgcggtgagccgagattgcgccattgcactccagcctgggcaacgagcgaaactccatctcaaaaataaataaataaataaataaataaaataatggcccctatctcatagaattctgaggattgaataagttagtggatataaagctcttgtcacagtacagagcacaagataaatgctatgtacattagcaatattattatccttgttaatattatgattattatttatcattatcactatcatcatcgtgtgatctgggaagcccagggatcccccaagtatgccaggaagggaaaccctggcctgctctctctctgcctccacctgcaggaagctctccccctcttcccccaccaccatctcctcttttcaaacctgaattcggagctgcaggctgcggttggcctgctccagggatcgctgccggctctccaggtctttggagcgctgctgctccttctgcagcttgcggatataatccacagaggccttcaggatggtgcccttgttccagcgcatctccctgtggggcccaagtgggaggcaagcaggaaatgccacatgaggagtttctcaggagctgaggcggggattgcaccaggtgggagcctcccaccacatgcttagaacttgaggctggggtctttcaaaggtatggagtatccagaggaaaacttcccgcctggaatcttacaatggtgccccatcacactccaaaccctggaagccgtctctgacctgaccccttaggattcctctcttccctatgtccctccgattgatctcactacagccacattggtctctcagtgctcctagaatatggaaaaccactcccatctcagggcatcaatcccagccgtgccctctgccttgaatactcttacccccagacacccatgcggctccccgccttgcctccttaggctctttattcaaacgtttccttgtcagttggggcctgccctgtcctcaccttccttatcccaaactaaccctccccaacattctcccattttccttccagtctttattcttctcataacactcatcataatggatctcatggatgtttacttatttactatttgtctgcccccactaaaacatcagtttcatgaggtctgttttgttccctctggtatctttagggcctaatatggtacctggcacaaaccagaggttcaaaaaataaatctttctcttttcctttttttttgcggggcggtgggggatggagtctcgctctgtcacccaggctggagagcagtggcacaatctcggctcactacaacctccacttcttgggttcaagcgattctcctgcctcagccttctgagtagctgagatgacaggcctacgccaccacgcccagctaattttttttgtattttttgtagagatggggtttcaccatgttggccaggctggtctcaaactcctgacctcaggtgatccacccgtctcggcctccccaagtgctgggattacaggtgcccaccaccacgccccgctaatttttatatttttaatagaaatggggtttcaccatgttggccagaatggtctcaatctcctgaccttgtgatccacccgcctcagcctcccaaagtgctgggattacaggcgtgagccactgcgcccggccatctttttttttttttgtttttgagacaaagtcttgctctgtcacccaggctggagtgcagtggcaccatattggctcactgcaacctccacctcccgggttcaagtgattctcctgcctcagcatcccgagtagcggggattacaggtgcgtgccaccacgcccagctaaattttttttatttttagtggagacagggtttcaccatgttggccttcacctcctgacctcgtgatccgcctgccttggcctcccaaagtgccaggattacaagtgtgagccactgcacctggctaatttttgtattttttagtagagacggggtttcatcatgttggccaggctagtctgaaactcctgaccttaggtgatcgaccccgccttggcctcccaaagtgctgggattacaggcatgagccaccacacccggccaataaataaatcttgaataaataaaggaagtaccattgcaccactgcactccagcctgggtgacagcgtgagactccatctcaaaaaaaagaaaaaaaaaaaggaagtactaagtgaacagaaaagtaggtgcatatatcctacggggaccagatggggcacacagaccataacattatgtgcctaaaattttaggtgctgacatagtgagggtctgcaaccctgctcaggctgagaaagaaccagacagaggagaaatgcctgggccgagactgcctggtgagcccaccaaggcacaattttagtagcatgggacgcctgccccacctcccgctggcctgagggtcccagcccagactcacgggtcactggacttagggatgagagtgcccagttccttgatcctgtcgttaatgttgaatcgcctgcgacgctcaactttggagaggggaggagaggaagaaagagtgggagaaagagttgtcaattagccaaaaatggaagagacagaaagtagggagttgggaggctgttgcagggaaggagttccccatggggggccaggactcggggtgaggcaggcctgcacagcacccgggcaatgcacacgctctctggcttacttaggttgtgattgtctttcttctgccgttccttcaaaagggcctttgcctcggtctctggaaaagagtggagtgatcagggcctctgagcacaggaaggcaagaaacacatgcagatactaaggtagggtttggtagccaaaagcaggggaaatgccttttttaaaaagtgccttctttttactattttaagccatggtgataggctggttgttaaatccaagacgagaggaactgaagtggggtgaaagcaagaccacaagccatagggggaaaggggacaaacagcctccatttccatatgtccaaaccattcccctcagaatcaggcccatctctagacctggtaggcacagggctcacctggggtaaagtgtagggccatggggccaagaccctatcacctaccagagatctcccgtttgatgttgggcagctcagctgggcaggagttgctgacagtgatggctggtgtggccacgccttgactactgtacacatcaagcagattccctgacacaggcagctgggggcagagagggcagagaaccaccagttgggaacaaacccaggcttggctcctcctcagaaccaggttcctgagcttccacatatcccaaagatggggcaccctctaatgcaaggactggctgactcagcaccagaacccttgcttctccttcaaggcaaattcacatggcgaccaaacagggaggacagagcaaactggacctaccttgcttcgctgggagactggagcctgcctggcctgcttatcacttcctccagtccctcatatccctcagtgacctctaaagcccctttcccaaaccccggggctggctctgagaagaaatgctggaaaaccacccttctcaggtctttgtcggctctgatgggacattccagtccgttagctcctcccagcacaacattccaatccagcattcttggaacactccaacccaatcttctccgaccttggtaaattgtcatgacaacattctatccaaaatctggccttctggagaattccaacctaatctccagtctttcactctgatcaagttgtaccatcttccactctgatcaagttgtaccatcttccacatcagggtctcctgctgctgtggaccaaggtcctgactccagtatcttcctgcacattctgttctctcaggagattcttatccaactattcaattagcactgctttatgtcagcctagtttttttttttttcctctccttcacactttcctggatatactccagaggagcacgtcaatcttaagtatacccagggccaggtgcagtggctcacgcctgtaatcccagcactttgggaggccgaggcgggcggatcacttgaggtcaggagttcgtgaccagcctggccaacatggtgaaactccgtctctactaaaaatacaaaacaacaaaaaaaattagccaagcatggtggcctgcacttgtagtcccagctacttgagaggctgaaacaggagagttgcttgaacccaggaggtagaggttgcagtgagccaagatcacaccactgcactccagcctgggcaacagagcaagactctatctcaaaataaataaataaataaataaataaataaataaatacaaataaaataaagtatatccaaatcccacttcttcatgagttttaatctctttttttttttttttttttttttgagacggagtatcgttctgtcacccaggctggagggcagtggcgcaatctcggctcactgcaagctctgcctcccgggttcacgccattctcctgcctcagcctcccgagtagctgggactacaggcacccgccaccacgcccagctaattttttcgtatttttagtagagacggggtttcactgtgttagccaggatggtctggatctcctgaccttgtgatctgcccgcctcagcctcccaaagtgctgggattacaggtgtgagccaccgtgcctggctgagctttaatctcttgaacccacttccagtctggtggatataaggtcccattctctagttgtgtccaaatcaataaaaagttctgataaattagtcccatttttatacatgcttccatcctattgataagttggaaaaaagcaaaactacagccacttggtatgctctaaagcaagttatgagaccaggcatggtggctatgtctgtaatcccagcactttgggaggccgaggtgggcagatggcttgagctcaggagttcgagaccagcctgggcaacacagtgagaccctgtctctactaaaaatgcaaaaaattagccaggcatggtgacacaagcctatggtcccagttacttgggaggctgaggtgggaggatcacttgagcccggaaggtggaggctgcagtgagccaggattacaccactgcactccagcctgggtgacagagcaagatcctgtctcaaaaataaataaataggccgggcgcagtggctcaagcctgtaatccgagaactttgggaggccgaggcaggtggatcacctgaggtcaggagttcgagaccagcctgaccaacatagtgaaaccccgtctctactaaaatacaaaaattagccaggcgtgctggcgggcacctgtaatctcggctacttgggaggctgaggcaggagaattgcttgaacccaggaggcagagggtgcaatgagcagagatcgcaccattgcattccagcctggacaaggagagtgaaactccatctcaaaaaaaaaaaaaaaaattcaataaaaaaaaaaaaataaataaataaagcaagttaggccaggcatggtggctcatgcctgtaatcccagcactttgggaggccgaggcaggcagatcacaaagtcaggagattgagataacctgggtaacacggtgaaaccccgtctctactaaaaatacaaaaattagccgggcatgggggcacgcgcctgtagtcccagttactcaggaggctgaggcaagagaatcgcttgaacttggtaggcggaggttccagtgagccgagatagcaccattgcgctccagcctgggtgacagagcaagactttgtctcaaaaaataaataaataaatataataaagcaagttatgagactcttggagtgttcaaaaccagaatgttacaatggtatatcccttgctctagaaagttttatctactgactagaaggactctgcctcctggcacagttcacttggtatattccaatcactacgagatccaactacttgttataacccacagcaagtttgaaaacttttgttatgcttcaaggccaggtgtggtggctcacacctgtaattccagcactttgggaggccaaggcaggtggatcacttgaagtcaggagttcaagaccagcctggctcacagggtgaaacccggtctctactaaaaatacaaaaattagccaagcgtagtggcgtacacctgtaatcccagctacgtgagaggctgaggcacgaaaatcgcttgaacccagaggctgcagtgagccaagatcgcaccgctgcactccagccagggtgacagagtgagactctgtcttaaaagaaaaaaaaggtaaaaataaaataaaacaaaatgctccaatcattacatggtctggtgtatatgtcccgatgacctgaatcccttggtacattcaagttgctataagatgctcatctcggccgggtgtggtggctcacgcctgtaatcccagtactttgggaggccgaggcaggcagatcacgaagtcaggagttcaagacccgcctgaccaacgtgatgaaaccccgtctctactaaaaatagaaaaattagcttggtatggtggcacgtgcctataatcccagctactcaggaggctgaggtaggagaatcgcttggacctgggaggcagaggttgcagtgagctgagaccgcgccactgcactctagcctgggtgacagagcgagactccgtctcgaaaaaaaaaaaaaaaaaagattatcatctcttggtacttctcacagcaaagcccaagcactttgatatgccctactgtctcagtgaactccccacctgtatctctcacagtctacatggtccacctctcaacacagtccaacaaggtccaaaggcattgttgacataccctgttctcgtcataaggcctccctctctatcttagcacaatcaaggcaagggtctcctatacacacagccagactgagtatggtcttggtgatacagaaatgccctaattttcagaccaacctcccatctcagggcctcaccgtgctggggagctgcagtcctgtggtgcctccgggcagatagctgagcatttcatcattgtaactggactccaggctgatgatctcatcaatgacatcatcaatctaggggaagaagtaaatattatacaggtttagaagaatttgggaggggaatgtgggaggaggtttggctgtagcctcttacctccttctctgagctggacccgatggtgagcagcgccatggggctgttgggcgcactgcctgtggggccggtagtgtgggcagcctcaggggcaggcagtggctgggcacttgcgggccccggcggtggggtgagggcctgggaagccagcttgggcccgagtgtggtggacaggtactgtttcacctgctgccggcgcgcctgctgcaggtggtagcgcgttgggttctccagatgggtctgcacctgtgaaataaggtagacaaggaaagagaggggacaaggcagaacaggactcaaaggggtgaattctgagccccagcctgaccctcctaactcattggtgcctagactcacgcagacaagctgggcccagaatctgagaacaccccaaaaatattagcgagtctcccccaggacccaaactctctttctcagaaatccttcacagctgccaagatccacccatgactgacaggatccctcgtagtttctggaaaaccctgtcacagtccccaagattccccacctagtctctgacaccacctaatagacctgggaaccatacaatgcttcccaagaccccctaatggccaaagaactaatgtatcccacacacatgaagctcttcctacaaagccagggcccacttggggcactcatgagcctccatggtccaccaagacatcctcatggcccccacgaactcctcgcaatttcacaagatcatctcagaaacccaaaacacatgagacatgaacacagataatttaaacagtaccagggaccttccttagagcccctaagaccttgcccccaaatcaccagtgcatcgaggccatccctagctcctaggatcactcctcagtcaccaggagccccctcccagggcctctggatctcaccttaccttgagcacctccctgggcacctgagcagggggtggacggctcaatgtgtggcccccagcagagacgccaaccacagagatggcaggagaggcaggtgcaggactggggaagggagccgcggcggcctgttcccgacgctcacgcctctcctgctcctgcgcctgggcccgcattagctgctgccgcagcaagaccctcgatgaagaagatgacgacatggcaggggtcctggagccccctgcagaagacgatgcagagagtgtagctggggtggctggtgtggcctgcagtgatattgggaggctgtggaatgggaaatatggggccatattttaggtaagctaaaagtctcatcccaagcctaaagggtcttagcgtgacggagcagacacaggaaccaggcctgttctctgccttccgaggccacaatgtagaagcagagacacaggaaccaggcttggtgatggctctcaggggtcacagtctgatgggggacacactggaggtcagtctggtgggggagttttagcctttggtccttatggtgaagcctagatttgagcctgttcacatattaagtggagatgctattgttcagctctgcaagggggggtttgtcctatttacaggagagcagaagaagcagaattgaggctttggcagcagaatgtggatacagagggctcctaagcccaatgtgaggctagagaagctctctgagctcctgggggtgggcgtcaggtgataggagaagccccaggttcctcttcttcccctgcctgggcctctggtcccaggagctagtcagtcttgaaaacctcggagatttcacaatactctcttcctgcccctcttccccctcccctcccctctctcagagcccgggccgatgactcagcacatttagacttccaagcttggggaaagaagagaccagcaggggctcctcaagggctgagggtgggtgagttggtagtgtgggaagggactgagttggggctagaggcatgtccccgcccacccggggacatgagtttaagcaggccacgccctatctctgagcactccaggccggctggaacacctgaggctgaaacacttgcatatgaatgggtgtgcaggtgggctgggggcaggcaggggaggtcttgacagagatactggaatcctagcttggccacctactttcctgtgtgacatgctctttctggtccctaattttaccaccactagaaaacgcaggctggtgaaagaatgggttgggctggtactgagggcctctgcccatcaagaggggagaggagggctgaggaattgggaggggaatcagatagacaagtcatacataccttgagcgaaggggtaagggttggcttttgagctcgtagaagctgtcaggatcaaggacgttttctaattctatgtcagcaacaatcccggattccggaagcaaagagttcaggctgagggggaggtggagtggtggtcagtgattgaatgaaggaccttattccccagccctcccctgagacagagaaagagacagagagcgggggagaacgaagaggagggtacaagcccctcatatttggccaccttgctgggtaccacaccaccatgaattcccacctccttcccccatccccctttcccttccccactgtgttactcatagtcccttaggagtcagaataataagaacgcctgcatcccaacccccacactgtaacaacctgggtttgaggaaaacagaatttaggaataacaattcactttatagaaggattcctgacttcctattcagagttctcccagcccccataccccctactttttttttttttttgagacagagtatcgctctgtcaccaggctggagtacagtggtgcgatctcagctcactgcaagctctgcctcctgggttcaagtgattctcacgcctcagcctcccgagtagctgggattacaggcacacgccaccacgtccggctaatttttgtatttttagtagagacggggtttcaccatattagccaggatggtctcgatctcctgacctcaagatccgcttgcctcggcctcccaaagtgctgggattacaggtgtgagccactgcgcccggccaaccccctgctattttctttacagctgaatgtgagcccaggtatatgtgtgtacacacacacacacacagagcaagtaggggcatccctcagcataacagtcccttgtaacacaaactgaatgcatcacaaagagaactggaaataattcacttgacgtaaagatctaccatttcacaaatgagtttctcccagccccagccagagttcatgggatgccaacacatgcctaaatataaaatagaaatatcaaaggctcccctcgctccaacagactggatttacaagagggagaatttgggtggttgatccactttatacaagcattcttttcttaccggaggagcctgcccagccttctcctgtttttttggatagatcaaaacacacacacacccccaacactaacacccactggcgcacaaaataagaagccatatacacccatccctttaactatgtccactactgcgatgatctaggttgttacagaggaattagaagatggtgaatcgatatacagaaaggctctgctcagccccagagagcaagggacagttaacacacacgtggatgaatatgcatccttcaatttagctaaacatttagaatgctgagagattgctggtgacttcacttgacaagaatcctctcccctccccaaggatctgtcttccttcctctcctcaccctcagatggagccctaaaaccacccaggaagttgggaagaggaagctcgggcaagccactgagctcagcacaatcccaggcacaaaggaggcaaagaccccccccacccagggctcacacacccattgcacagaagttggaagagatgggcactggggtgagcagggagggctggggctccaaagcccattgatgaaagtaaggatgagaagaggccagaggggatccacccaggcagggatggtgcaatctgtactcgttccagctctatggacagattcaagattacccccaggagctcggagatcgaaaagaagataaaaagaaaaggggtgtggggctagggagtgggaagggctgagaggctagagcgagtagcagcatgaacaagagcctcctctgggttcccaaacaaggtctgaggcctctgagctaagaggtaacatcatcgccctctgcctggctgtctatcttccattcaggcccttaacaggtgtgggaagagggcttttccactatccttgggatctgccccagctgggtaggcgggcagaggggaaaggattattctggtcaagtcttgctgaatgttgcttctcttgttcattcacacgcactcacaaggctggtcccaggcagcatatctgagatacctccaaatccctccagattcatgttatccccaaacacagcaaccagtcactgagaggcaccaagctcccaagacagcacttctgtccctcaggaccccttctcccacactgagggaaaaaagattctaggattcccttaaaaccagtgcctcacctgacagtgtcccctcaaattcattcccctcatgtccgactgaaaatccccgaattcagcctctaatcagagaccctgtctaccaagttcagctatctcagaccagtttctggatactccagaataggccccgctagacgcagtcaagggctccccaaacctgacccagaccccgcttaatgcactcccacgactcctttaataaagccacaatccaagcaggccactgccggattccttaggtgcccccccaagacgggcgccccgacgtcctccaaggctaggccgagggcctccaatcccagtccggggcccccgctgcccccgagatcaggcccctgggagccccagtcggcactcccagccccaggcggccccgcacctgagcagctgagccgagtcggccggcctgcgctcctccaacagcacgaacacggctcgagggccctccgcgctggcctctacgccatcccgagctggttcggccgcatgagacatgacgcccggccccgggcgagccctgccaggccggtcgggcctcggcccggtccccctaacaaaataagagtcccccctccccccagctcgccactgccgcctcctccgctaagccatggagctagcactgcgcgggcgggcggcgtctgggagatgggatgggctgtgagtcatcccccgcccagaacggaccgacgccccccctcaacctaaccccggacgaccgccctcctccccc

SEQ ID NO: 2322 - DNA, 10989 bp, Homo sapiens; identical to SEQ ID NO: 2316

SEQ ID NO: 2323 - DNA, 3286 bp, Homo sapiens
ctccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattgtgagcgttctggggcaggcgcgtgggcaaaagcgggatggggtggctggaccatgcggaactggatggtccgggtgaggcaggcacttggccggggcgctcggcagtggggtgcaggtgggtgggttcacggtggaggcccgaaacccggggcgcagggcgagtcggtggggtttgacgaaggttgttgagatctggtggtccccggggtgaagcaaggagcctataacgcatacggagggctacgtggggacagcctgcgtgaactcatcagtggacgcatcgaaggggtcccagggtgctgggaagtgggggcctcctgtggcagggcgtggcgcggcctgggcacaggagggcgggctggcagcgcgcccaggggcagggcctgttggggtggggcccccccgccccgcgctagtcccgcggtgtagagcgccccgcccttcgccagttcttcctcgcccttcagaggccgggcgggatgtccttagcttttcggggtttccacccttctcaaagtgggcgccgcctttgagtcacttgtaaaaggggtgcggcgcctttaacggagtcctgcctctctggtgtcactctcaccgcttcccaaaggggttgctgggggaaccgcgtgttccgccccggtcaaggccacaaagctggcgtcagcggggctcacaaaacacctggcagcgccactcccctcaggctgcccgtaacctagaagggaaaagaggaaactgaggcacccaactctactccttacttgttgggtgaccctggccaagccattaaacctctctgtgcctcagttttctcgtctataaattagaaagagtaataatagtacccagagcattagattgtcgtgatgattgaatttggaacacagtgagcacataaaaagtgtttagctattattgtatgtcatttccccagccctcgtaggcatcttagtatgggacccccaatttaaaccaatcttctcagccctggttgctgattgaggtcccctttcccatgtcacccttccagatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgtgagaaggggtccacaatggcaagaccagggaggggtctgggcagttaggattgtcggggaactgtggttgctgacttccctcttctcctccctacacctcacaggatttcttccgaaccctcatagcggcaatcctctacctgatcacctccattgttgtccttgttgagagaggaaaccactccaaaatcgtcgcaggggtaaaggccatgggagcagctctgaagcacagagcgaagggtttgaggagccagggaccatttctgcctttgcttctggcagaaatcgtgtgacccacagcaagtcacacttgtcctcagacatggaggaaagtctggcccaggacttggttttgcctcccaaggtcttcatttgctgtgaagggaagtcccttgtcagacacaaggaccttggtgagaggtacaaacaggcggcccctttgtcaacgcactagactaccatctgcaagaactttgtcccaaatgtagtagaaattggggccgggcgcagtggctcatgcctgtattcccagcactttgggaggctgaggccgaggcaggcagatcacttgaggtcaggagttcaagaccagcctggccaacatggcgaaaccccatctccactaaaaatacaaaaatcagccgggcatggtggtgggcgcctatagtcccagctactcaggaggctgaggcaggagaatcacttgaacccagaagacaaaggttgcagtgagccaagatcatgccactcactccagccccagtgacagatgggtgacagagtgatactgtgtctcaaaaaaaaaaaaagtatgacttgaattgtgccccctacgggtagggccacagtgtggcctccctgtgttgagaggtataggaggagggagagtggggtaggatgcactctcttggcctttccctggcttaccaacccggtgcttgagtcccatcctgcgtggggcaggtgctggaggtggtggatacaagaagataagagactgagtaacctgaccagctaatctaaaccccctcactcctatcctgtcccccaggtactgggcctaatcgctacgtgcctctttggctatgatgcctatgtcaccttccccgttcggcagccaagacatacagcagcccccactggtaagtgtgtgtgtgtgtgttggttgggggtaagggggttgctgagagggcagagggaaaaaggaaagggatctcttaaaggcacgaatgccaactctggtctcgtattggtacttagggcttttgtaccaataggtaccataagcttcggtattcttgtgtgtaaaatgttcatggactttggatcttgttttaaaaaatgggcatatagattcagccaatgctttctctcttttcctcacctgcagaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaa

SEQ ID NO: 2324 - DNA, 10872 bp, Homo sapiens
ggagggaggaagaggatttatgacttaggttgtaggggcggggcgtgggggtgaggggcatgggcctcatcatctactctgactggagaatggagccccctccaggacggcctgccttcaagccacgatgcagttcttgtctcgggcctgacgaggcatccctgcgcgagagtccctggggagcgataaagatggggagttgaaggtctccattgcagtgtcctgagcaggcatgggcctgcacaaatgcgggggcagagggatgcgctctcctaggaagaagccatcatcctctgatgattcggaactggaactggagggcgagctggagcaagattccgagtctgaccctgatcccgcgtcacattgatagtggcgacgtctgcttgggtggcggttgtgatggtgatggtgattatgatgatggtggcggcgacggctgggggccctgggtgggggactgcgtggcctgcggcgctgggccgggggtgcactcagggtccggcgcgggcctccttcagacaccagagggtcgcggaagctgacgcgtggggtgctctgacgaccgaaggcactatcatctgggcgcaggttaggctggccgggggactctgggggcggctcggggacactgcggagccccagttccggcatggagtggcggtggggagcccctctcagaaagcgggagggctcctcagggcctgtagctgttaagggggagacagagtgactccttgtatctgccctcccactggccccctcctaagaggaggcctgcggaagggccttctttcctccactaagactgggaaagtgggggcaggggtcggagaatggcagggaggtgggaagtctgggaagtgtgaggcctggagcaggctctgggtgttgagagggttggaaggaagaacacggagcaagatgggactggtgtggggggcgtggccagggcacccggggtggcttcggatggaagaggtgtggcataggctggagtagatttggtttgcaataaaaggggtggggcctgactgcagaggatgaagggtgaccggctggagaagaggaagaggaacttggggtcaagcagagacaagttgaggtaggggaccagccctgtattgacagggtggaaccagggttcatgaggcgggtgtagtttgggatggaaaccaggcctggactggtgtggggaaggaggatgagctgagaaatgggcggggcccagggatacagcaggtgaagggcctgggctagtcaagaaggaagggccagggctgaggcaggggcaaggacataggggtgactgggctgtggctgggtgtggctagagggttagctcacctggcgctaactctgtgctggtgcctttggtggtggtctctgatgcccccttcacagcagagaaagaggctgtggaggctgcaagtggggctgtgacagggccggcactccagctgcggcggctcggccctggagctgtgggctcggacccaaggctgcaggctcgagagcagaagattaggcctcggcgtggcaggaatgggcggcccagcagggcccgcccacagcgactacagcagaagcagcggtctgaggcatgccagtgctggccctcgtaagccatctggccttggtccaggcctgtggggaacgacgagggggaaaaactgaggcagaacccccaggcgtaaccccacccctcgtgaacgagtcccttctcaagaagaggtggggaatccgaggcagggcacccctgggtgccttcctccctcctccagaatggggcccttttggagaaagcaggaaacaggttttggttctctcctggagactggctggtgaacctctctctcactcctccctttctttcccagggtgctctctcccagagcggggtgggcattggactctaagattcgggccaggcttagacattagggggtggctccaagtggaaggagaatggaaagctgggcctgaagaggaggcctggctggtgggggcagggcttagcaggtggggagtggccctgttgagaaaggagtggttctcagaggatagggtgtagctagaagctaggcctgacttaggctgatacaggagagtggaggagaacggggcacagcttggggtggtaaaggctaggagtagggcgagccctggggctggaattagagcaccctctggaggtgggtgtagacatgtggtggtggcctagcattgtgttaggtggggtttagaaagcatggcatagtggggacattgggagtgggacttgcaaccaagcgtacaggtctatagtgttggggctggacaaagtacagggcacaatggaggatggggcctggaggacaggaggagtcctggtggggtaggactgtggcccagctgtccatccatccctctgtccagtcccacagcattcacccaccgatgtgctccccacagccatcacagtactccgcgtggcgggcctcgtagcaggcgcagcagtgggggcggctctgacgcatgacatagcgctgccctcctagtgaagcttcacactcaaagcagcagaagtgatccatgtgccagtggcggccctcagcctccgtgcactcaggggagaagatgatctggagggcgcaggccatctgtggctgtcagatgagcctgctcctggccctgcccaccctcaactcccacccctgggcagggaggcccaaacctcgtcacaggcttggcagcgtggacgcaggcattcggcatggtgacgcccgcagtagaccttgccaacatggtagaagtagatgaggtcaaccagcagttcctggcacgtggtacacacgaagcactgtgggtgccagcaggcacccaggcctgcacggctggcaaacactgcgatgtccccacctccaatctgctttccgcactgccatgagacaagcaccaagatggttaccatcactgtcaccaagatggtcagatggatggggtcagccaaagtatgttacacttgggcctttcccacagtgaaactttgtgatcagccccacccatggggtaactttgacacaggccctgcctataccagggatggggttgggcggtaccttagagactgaccctgctcatgagggaagccgtagagacaggccctacccatggtgggtggccttataggcaagcctccctcatcaggggtggggaagacagacaggccaggcctagtgggggaaaccacagagatagtctccacccaccgggaccttagcaatagatctcacctaacagtaggatctaaggacaggccctgcttaccactgggccctgcagacaggccctgccactgtgggtcagctcttgaggacaagttctgaccacaggaggaccaaagagatagcccatgccccatgtccactgcacagacggggagaaaaacacactaaggcctccttacagacaaaccccacacgacagtgggattgatgggacaggtccctgtccaccaggggttgccttagagacagtccctgcccaacagtgagatgtgaggaacagaccccgcccacaagaggggaccctagagacacctcactggggcttaagtggcaggcctcatcttcccagtgcttggaagatgtgtcctgctccccagggcttggagcagaggcactgctcactcgctgaggccctccacggctcacctcctcacagatggccccagtgatggtcaccgggaagatgcgcacgatgccacgccccagattctcccgcttccgctgctggctaaaggctcggagctctttcttttcctcctcttccagtgctgtgcagtactgtgcctgggaggagaaggcatctcccaggctcctcccttgatgcctgtccctgcccctcttccagacttcatccatgccccgcaagtttacttctaggtctttctatagatggtgcctcctgcctgaagtaaccacctcttcttccaaggcccagctgtggttttgccaaggaatgtcccctgatgacccctgcctgtctggaccactcacctcagatcagctcacctttcctcctctgaccctgccctgcattggcccaggctgtgtgctgtgcctggcatgcccttcctgtcttctctctcctcacctcactgtcgtgtgggggcagctggtgcagcagctgcttgatcctgtatttctccccaggactgttgacgtaggggaccttgtcctctgggaggcagctgaaaaattgatatacctgggaggacataggagtgggagaaaacaactgaaatgagaggtgagttgggatgcagtgagatggcgggtccccatttctcagaaaatgaaaggcattaggagggaccttctgactccctcatctctccttcctaaaggcggatcatttccctcagctcccagctcccaaacacgctgagggttcctgcatgtattgacctcacttcctcctccagctgctgatcacctttttttttttttttttttttttgagacggaatctttctctgttgcccaagctggagtggcgcgatctaggctcactgcaacctccgcctcctgggttcaagcgattctcctgcctcagcctcctgagtagctgggattacaggcataccactatgcccagctaattttttatttttagtagagacagggtttcaccatgttggccaggctggtctcgaactcctgacctcaagtgatccgcctgccttggtctcccaaagtgctgggattacaggtgtgagccaccgcgcccagtctactgatccacttttctttttccctttacaggaaaattcctcaaaaagttatgagcacttgtgttcactccacttcctgtccttccaatctctcttgagcctacttgaggcaggcttccgctcccatccctcttccaaagctgtcaaggtcatcgatgacttccccattgttaaaatcattgttcaggtctcagtcgtcatcagacttgatgatggtagcactgcaccgagctgaccactctctcttcctggaaacactttcttcccttggcttccaggacaccacacagtccaggttttccttccaccttattggctgctccttctttgtccctgttttggctcctcctcaactagctgacccctaaatgcaggaggatcctaggactcagctcttggtcctcttgcctctgtctacattcaatttcttgggaattacattcaaccttatggctgtaaatatcatctacttggctggctaatgtgtcacctccagcctgtgacacataatgacaaacacatacgtccagctctgtaacttatcccttgagttccaggcaatgtggctatttagatgtctaacaggcatctcaaactccagatggccacaaccaaacttatgctcttacccctcaaactgctcctgtcttggcctctcccacatcagttaatctacctatcctcagggtcatctttcactcctctttctcccacccccacaagcaaatcctctgagtgctacttccaaaatataggctgggtgctgtggatcacacctgtaatcccagcactttaggaggcccagaggggaagatagcttgagcccaggagtccaagaccaccctgggcaacatggcaaaaccccatctctacaaaaaatacaaaaatcatccaggcgtgatgatgcgtgcctgtagtcccagctacttgggaggctgaggtgggaggatcacttgagctcaggaagttgaggctgcagtgagctgtgattgagccactgcactcaaacctgggagacagagtgagacccccccccatatatatatatgtgtgtgtgtatatatatatatatatatacacgtataattattatacgtatattatttacgtaaattatatacgtaaaataattattttatatatatgtatatagatgtatacatatgtgtatatatatgtgtatatatacgtatatatgtgtatatatatacgtatatgtgtatatatatacacgtatatgtacgtgtatatatatacgtatatatatatacgtatatgtacgtgtatatatatacgtatatatatacgcgtatatatatacgtatatatacgcgtgtatatatatacgtatatatatacgcgtgtatatatatacgtatatatatacgtgtatatatatatacacacacatatatatatatattaaataattatttattaaacggaattttgctcttgttgcccaggctgcagtgcaatggcatgatctgggctcaccgaaacctccgcctcccgggttcaagcgcttctcctgcttcagccttccaagtagctgggattacaggcatgtgccaccacgcctggctaatttttttgtatttttaatagagacggggtttctccatgttggtcaggctggtctcaaactcccgacctcaggcgatctgcctgcctaggcttcccaaagtggtgggattacaggcgtgaaccactgcacccagcctattttttttttttttgagacagggtcttgctctgtcgcccaggctggagtgcagtggtgcaatctcagctcactgcaacctctgcctcctgggttcaaggaattcttgtggctcagcctcccgagtagctgggattacagacatttgccaccatgccagactaatttttgtatttttagtagagatggggtttcactatgttggccaggctggtctcaaactcctgacctcaagtgatccactcgcctcggcctcccaaagtgctgggattacaggtgtgagccaccatgccggcctttctgtctgtctgtctgtctctctctccatatatatataactccttgcactgccagtgccatcatcatcaggttcctcactggtctcctgattccacccttattcctccaggctgtcttctgctgacaaccctcttgcgacttcccttcattcacaggcaaagccaaagtcctctccatagcccctgccacatctctgacctcatctccagctggtctcccccttgctcactctgcgccagcagcactggccttgccatcccttacatatgccaagcacacgcctgcctcagggccttggcattagccatgccctttgcctgtgtgaatcgctgtaaccttagatgtctgcatggctcacttctcacctcctttcgggcagctcaaccattaaattctcacagaggcttattctgggcaccctatttacaattctagcatctctctccttccctctctctttcttcaccccaccttccttgctttttaattccatagcccttacaccatctgacatatatttacaggtttgcttattgggtgttcctcctttccagaatctaccctctgcctgggcagattttttttttttttttttgagaagtatcactctgttgcccaggctggagtgcagtggcacgatctcagctcactgcaacctccgcttcctgggttcaaacaattctcctgcctcagcctcctgagtagctaggattacaggtgtgcaccaccacacctggctaatttttgtacttttagtagagacggggttttgccatgttggccaggttggtctcaaactcctgacctcaagtaatccgcccgcctcagcctcccgaagtgctgggattacaggcgtgagccaccgtgcccgtgggcagatatgttattttgtgttttgctcattgctgtgtcctcagtgcctagaacagtgtctcacatgcagtaggtgccccataactatgtgttgaatgagtcaatcaatgaagtcatgtggtgaatgaagtgctgggagggtagaatagggagtggggccacgcatggtggcttgctcttgtaatcccagcactttgggaggccgaggcaggatcacttgagcccaggagttcaacatcagcctgggcaacatagggagaccctgtctctacaaaaaaattttaaaaatagccaggcagggtggcatgcacctgcagtcccagctacaagggaggctgtggtgggcaacagagtgagaccctgtctcaaaaacaatcaatcaaaaataataggattggggtgaacaggccctgaggaactggtccctcagtcacccaaggtatggggggctgaccactcttccatcacagaggggccagaaggaccctcggtctgactgcacactctagcgtagccccagaaataggttcccacctgagtgtgtgtgtgtgtgtgagcattagtgtgcacccactggacagcaagagtggagggctggcctctggtcacctgctccggcttaaggcctgggggcacccaggcatactcctccgatgcacagcctgagtcgtcgtcggagatggagtggcgctggaagtccgagattagccgacacatgatgcgttccaggtccacaggcaccgcgtgcactgcatgctcctcccgcgggcatttgcaatgctggcagatctttctgagggggccgggatgggggtcaattactaaggagttgcccacccgaacccctcggcagcccaggtccaatggaggagcggggacatacagattatcaccaccaaaggtctgtgagcagggacagggatctgggcctgggggcggggctgcaggaggtgggcctatgagccagggtgtggctgggctgtgagccagaggacaggtcgtggggagtgggatgctttgtgggggaactttcactagacacaggcatctaacctgtggtgaggctctgaacttgtgggctctgagcctgtgggtagggcctgagtctgggggctgtaggctctgtttattgggtgcagggctccagcaggaggataggacgctgggcctgggagagtaggtctgagtctaagaggggtgctggaggccagagggcggcgctcaaagttagagacgaagaatctccctagggatgcgactccgcggctacgggagaacacttctgggggcggggctgcgtagtgggtggagctctcctgggaaaggactttggggaatgagtcagggggcggggctctgaatctgagcctgaggctcttttcccaactgagatccctctgtaggcggagctcaagcgtaggggcgtggcgtaaggctcctggatttccccccgaaggcggagctctgacaaaggcgaggccctttaggggcgccacttacctccagccgtggagcaggaagccagggcactgctccctacaggagttgcagggctggccccggtctgggtcctctgcctctggaggctgcagtgggcgggggcagatgcagggccgggtgaggcgcggaagcagggaaggagaagtcaacgcccgcccctccacttcattgcccgcgaccgcacgctggggcctgtcttacctgggcagcgctgggcaggctgggacagcgcccagagtgcgggggagcgggacacaaccgaggcagaggcggggcagttggagccacctccttatatgtccccttttcagggaattccccttcctaggctggcctcggacccccctccccgtccgcccctagcctcagacacctcccaccagccttagatccttccagggctcaagcacctcccctataattcattgtactctccccactagagcacagaacccctactctgggcatcctctccccggcctcatcccggttccctctccatctacgccgccagcagcactccagttccacagggtaggagacgagaccgcattcttccttgagatccccacgtgaaccctgcccctctcttcagaagctcaggagctcctcccctaaaccctggcctcatgccctgatacccaaggaactggggaccctccccaggatctcaggaggcccctgctccattcagaaacccccatcccaagaaaccttggcctttacccatcccatcctagggctatttattccttctccggaccatcaaacccagaccccacattcccaggtcagagacccactccaaaggaagtgaaagaacctcctgtctaagaagtcaaaaactcccttgctcaggcggaaccctggaagccttgtccccccaaatcccagtctcttgactctcagcatttcggcatcccaggagtgtaggactccatccctccgtgcacattcctccaaggtactgtgtcctttagaagctgaggaggtcggccaggctcggtggctcacgcctataatcccagcactttgggaggccgaggtgggcggatcacctgaggtcaggagttcgagaccagcctggccaacatggtgaaaccttgtctctactaaaaatacaaaaattaggcgggcgcggtggcgggcgtctgtaatcccaggtacatgggaggctgaagcaggagaatcgcttgaacccaggaggcggaggttgcagtgagcggagatagcgccactgcactccagcctgggtgacagagattcagtctcaaaaaaaaaaaaaaaaaaaaaaagcagcagctcaggaggttcctgctcaacctaaggcttcaagacccagttctctggccctcaggattccctcccacaattcataagagaggggtccccaccaggtcccaggagtgctgatgaaagtgtgtggagaggtgattagggggtttgggccaccagatctacaccttcctccatccattcgcctccagcagccccagccccaggtctgggaatgcaggggatgggattcccagatcctctgtggggcacctattcgctatgcctatccattgcccccttgcctgggcctcagtttacccccgacccccaccgctgccctgactcccgctcaccgcacgcccggagcggcgcctccgggacccacgcgcgaacatggcgcgcccgggcagggtcaagccgg

SEQ ID NO: 2325 - DNA, 12398 bp, Homo sapiens
agactaggtggttaaggagtttatttgggagaggagaatcatatttgttcttccttggggaggggggttctttgaacaataccgaagggtttgggaaagggtaggggtctggaggggagaaggaggggccacagccagacaaaatggcaacacacgatcacaggcactactgacatcacagacatagcagagggtgcaggataggggctccagaccaggcctccaaccaccccaggacgggtggaggtgtggagggagggagggcgcaggggaagggggaagaggggtgggccagtcccacagacccgttggttctgtcctcctattaacctagctgtttcatcacgggagtggggaagggtgtgtgtggtggggtgcttctctctggatcccacgcctcaccctacaagccatatcactcgactcttctcaggccacttccgtcccaagtcgtagccagagccattctcccccacccctaacaaaacccatctggaagctcctatccaagtcccctctccactgcccaaacccagccattgtaaaacattttcttcactgcaccatggggaggggctgccctttctgaaaccaccatggaagccccattctaagccccaccctgtctggaaccctggcttggcccattcctgaatcccacttcttgccttgctcaagatctgtcccctttagaatcaagctcagtctcccaaatgttccaagccacaccctttccataggctctggtaccaatccaagacccacctactctggagcccaccattctgcctcgcttaaagcctcgccccttctagaaccctgccctcagcgcccttccaagccccaccccagaatgctctagcgcactcctctccttcagactccagatccactctgtctggaacccaacccccctgctgacccctccactccacacctcctctccaagaccaccttgggtcctaaactgtcctctctaccccaagcccccccaatctctgcctttctttaaccctggagttggatttccctaacggcctttgttcaggcaggcattgctggaggaaccaaggccagagttgggaggagtggagggagagagaggagagagtctgaagtcacgcccaccctccccacacagccgaggtctgttccctccctgtcctccttttagatccccttaacctcaggggacagggagggtaaacagagaggggccaagggatgcagggaaagggacggggtaagagagggggcccactcaagactgggcacctagtggatgaggggagtggagtgagggcagggctcagacagataaatagatatttatatataatatatatatatataaacagcaaagacagggtctcctggcttgaggggtggagacctagggtataggggtgggaaggggggcaggccttctcctgagctcttgccccccccaggtcctcctgggcttcactgacctgtagagacaaaagacacagaaaggagagggggtctgacatgggtggcgccctcagataggggttgggctgttatgcctttgtcctggctttatgtcttttcttctttcctggagccagcttcatcccagctgcctctgctgagaagatatacctgaccttgcccccactgggttaggtaccaaagagattacagtctccttcctccaaccaaaaaaatagtcccttaacaggtactgttctagccatttgtgataaactatattgagcaaaacaaagatccctgtctttgtggagcttatactgaagcagagatagacttcacacagcgaacatgatgcatgagtggattatctcgtataacatagggtgacaataataagtgaaatggaaaaaataaagtgagctgggcatggtcgctcacacttatagtctcagctacttgggaggctgaggtgggaggatcacctgagcccaggagttcaagtctagcattcctaaagtgctaggattacaggcgtgagctaccacgcccagcctgcgacagggcagagttctgacacaggaggactgtggcctaatttaggatttaacagaatccctccagatgctgtgagtagaacagaatggaaatggagacctgagaagaggtctgggagagatgacagtggaagatgaaggatatattttttgaaggtaggacccacaggattttttgatgaattagatgtgggatgccctttccatcctggctaacccagtgtcagaagctacctccatccaagtattgccaccttcttgccttcccccactttttagccaccccttagccttttcctcctgcctttcctcccctatatcctccctcctatctgagggaaatctcacttctctttttctttttttttttgttttgagacagagtctcgctctgttgcgcaggctggagtgcagtggcgcaatctcgactcactggaacctccgcctcccagattcaagcgattctcctgcctcagcctccagagtagctggaactacagacgtgcgccaccatgcccggctaatttttatatgtttagtagagacggggtttcaccgtgttggccaggctagtctcgaactcctgacctcaggtgatctgcccaccttggtctcccaaagtgctgggattacaggcatgagccacctcacctggcctcttttctttctttctttctttcttttcttcctttctttctttccatttttttttttttttgagacaaggtctcgctctgttgcccaggctggagtgcagtggcaggatcatagctcacggcagcctcaacctcctgggcttaagtgatcctcccacttcagcctcctgagtagatgggtccacagatgcatgccaccacgcccggctaatttttgtattttttgtagaggtgggatttcatcatgttgcccaggctggtctcgaactcttgggctcaagcggcccgcccgcctcggtctcccaaagtgctgagattacaggcatgagccaccaagccccgaccctcacttctcttttaaggcccagcaagaaggccggcaaacctttccagaaccccaccctatccctcttcctcctttgaaattccacactacttccctcccctccagcgttggggagaggcggcagatctatcccctcctcccggattggtgagctcgtctgaccttcaagatccacgcccatttaccctcaccatctattggccttatcacctattggcttatcagtcacttctaagacccacctcctcgtcgcttccgtggctcttgcgctccgctgattcgccactgcgcaagtcccccgatattccctccctttattggttgctctgcttctctccccctgcctttccgccgagttgcccttctacctccctcccattggctcttcattctgtccatcttgaagcaccattcttcttttctccattcattagctagtttttcagctcttagcaggtagttctgcctcttgattggctccttcaaacttcagtccttacttgccccagtaaacgccttacgtactctctacccctgactcttattggttcactgacccgctcgtctccttccttgtaccctccttggccgcaccgctcgccggtcactcaccagactacatctgattggagaaggaggtgggtgcaccctgcgggccgtagccttgctgcccatagtcgccctgaggcccgtagccactgccaccgctgccggctggttgaccatagtcaggctggtagccgccctgaggcccgtaggaatcctggggcccgtacccgccggggccctgcccgtagcctgcatcgccgtaggcgtccccgggtgccggttgtttctcgggggcgccgggaggcgcgcgcaggaacggggcggcccagcctgtctccttaaacacgaaccacaggttgccgacccagagcaccaggttcaggaagccgaacacctgcagggagacaaggctcggctgtggtaccccgcccattgccttggcggccctgcgtgcaggaatgagcatgcggggaatgaatccgtaggctccgcaaggtgggggtttctgaaacccagactctctgagtcccagtgcgagaacgtcgatgtgcagaaaaatcacctctggcggggtgggcgtgttagaagaatttggagccctggggatgctgcgatctatcagtattacatatacaattatttacatatttgcacatatacacattatatacacatttatgcatgtttaaaatgtaaatttgtaatatattcatagtaaaatgtaaggatacaaacttattaaatatagctataccactaacatgcatctaaataaatgtagataaaatatatgtataagtgcacatgtataagatatatgaaacttgcataattttttttttgagatggagtttcgctcttgttgcccaggcgggagtgcaatggcacgatctcggctcaccacaaccttcgcctcccgggttcaagcaattctcctgcctcagcctcccgagtagctgggattacaggcatgcaccaccacaccagctaattttgtatttttagtagagatggggtttctccatgttggtcaggctggtcttgaactcccgacctcaggtgatctgcccgcctcggcctcccatagtgctgggattactggcgtgagctaccgcacccggccacataaagtaattttaagacataaaacactttctgtacctttccttatatgccaagccctcttctaagagctttacatgttataagctcacttaaaattcagttttgggcaggaaatactatctccattttacagttgaggaaactgaggccctagaggctaagttacctgaagtctcacatccagcaagtgacaggaaagaaaagttgtaatcttagcatctgtaacccttgtatacgacttaccttgtgccaggcccttttctgagcactccgtattcttagttcaataaatactcaactttggagcaggacctattattagtcttcgattatgcatgctcaactgaaccttgagaggctgtgactagtttcaggtcagggagcttgcaagaggtagagctgggatttgagcgcagacagtctgactccagccagtagggggcatccaagtggggaaacatttcaagtttttccttcattttgcacatgaggaaactgaggtcccaagagggtgctgagttgcttattttacatgtctaggctgggtctgggatccaggtctcccaaacctgtcatgttccccctttggggacagtctgtggtgtcacagtggttacaattgctagctcatccttcaacgttgttgttggcacgcgttcttcagggacaccccttggatctcccctgactctcctcttattctcccactccaccactccccatgccggactgtactgttttccactctccctcctccagccagcacccagggcttaccaccgaggtgttgagtcccgaggtcacagggtctctcagctccttgcatgtgttccctgtctggcggcagacaggcatctccttgataatgttctctgggtctgtggccatcttcacatctgacagccccttggcccatgccgatgagctaactagccacatgaaggcgaacacagccgtggccagaaagtcctaaggcaggcaggggtgaggaagacagcactgtgagtggactgcttcacgctaggccctggggcctcctcggatcacaggtcccccagaagaggcctgtctctcccctgccttttcagctctcaagcccacaacactttcacctgaaggtggccctcccagcttgagcttgtgtgtgtacatgacacagaggatgtgggagtgtgattgtgatatgtggctgtgggtgttggggggaggggaactctgggatgatttccgaatctgtggaaagtaatgtgtctttctacttttgtctgcatgtgggaatttttgtcattttgtgtctaggctgagggtatgtgagtacagtggtgtaggaatcagtgtgtctgtgtggcatgatgacaggcatgactgtcacagcgaacctctgtgggcctcttcctttgatctaggctgtgtagttgtgtgagagtgggaaggttctcaggtgtgggcctgtctgggattctgcataggctgtatgtctccgtgactctatgactctgtgtcccggatgcctggtgtggattaatagcagcagcaactatatgtgtggctgttatggtggctgtttgcatgtgggcctgtctgggatttggtgtggtctgtgagcatggctgtgtccctggggttccgtgtccccatggtccctacatgcaagtggctgtggggactcaccagcatgggccctttgttattctctcggtacttgttctgcaggaagatgtaggtggccagagcccccatggagtagaggaaggcaaacacggccacggtgacaaagaattcggctgacgaggagtagtccccaactaagaagaccttggtggtgccccctcggcaggtgggtgcatcaaagtacacttggtgcagcctgcaaacagaggtgggcaggtgtggcccagcccctcagaacaccctcaaccctccagcccaatcatgggtccccccatttctgacaaggccccaggaagaggaggaaataaccattcatcgagcacctactatgtaccagtcacatttcactgattgctcaaaacatcctggtgagataggtgttattcatccctcactccaacccaagcactctggcctcttgattatttctagaacttgccaggcatcctccctccctaggatctttgtttgtactggctgttccctttgccaggaatgcttttcccctagatagcttcgggtcttactccctcatctcctttttttttttttttttttttttttgagatggagtcttgctctgtcaccaggctggagtgcggtggcacaatcccggctcactgcaacctctgcctcccgggttcaagcgattctcctgcctcagcctcctgagtagctgggattacaggcatgcgccgctacgcccagctaatttttgtacttttaatagagacggggtttcaccatgttggccaggatagtcttgatctcttgaccttgtgatctgcccgccttggcctcccagagtgctgggattacaggcgtgagccactgcgcccggcctccctcatctccttgaagctttgctcaactgtcaccttctcattgagaccttccctgatctccctacttaaaattaaattgaaacattctctcaaccagcacttcttagcctggcttccttgctccacttttctcgatagtagtggtacccatctgacgtaccaggtattttttttttttttaatcttggtttttgctgtaactacaagagggcagggctttttcctgtgttttcacctccgtttatctccaggccctggaacagtgctggcacctagcagacactcaagaaatgtttatcaaatgaaatgtacagaggcggaaacagaggctcagggaagtgcattaacttgcctaaagtcacacagctggcaagggaatgtcagagttgagatctgaaccttgttttctccctatctcatgttgacttttctcccccaccccagttcaggtccccgagagaaaaaaatgtatgcatagcagaggagaggccagcgactagataacaggaaaagacagacagaaagaaaggagggtaaagggatcttggaacagggtgtgtgtatgtgagggaagaggggaggtgtcctgggactaaggcctttcctgtggtgtgatggaggagaggtgggggttgtagagagaaaatgtctgtgggagaagttctggagcacagtctcagattggaggccaggatcctgagactgagcaaatggtgccaatgcctttgtgtagcaaaggccctgagggaagaggcttgcacttattagtcacctactaagcagtttacataaatgtctcattaatgacagcctccagcaattctctaaagaaggcattattagaccctttttacagatgaataaacagaggcttagcaaggttattacttgcccaaggttgtacagctcctaaatgatggagctaggagttgcatctgggtttgagtttctgtttctagtgggctgggtcaggagagggggtccctaagagggaatgagaggtccttgggtattagggcagtttgggagggattttgctcagggggacccagggccaagactgtttttctaggggacttgtgggctagagccttaggacccaaagttctagacatgggaggcgtggggagggggcacaggggatggttgtggtcttgtggatccccaaaggactggctctaagcagtgtcccttgctgccagctccccctccttccccagactcttttctcccttgcctttgtggacccatggatacctggctgcccctctgcctctcaggccacactttcccggcatctcctctcttttccatcattgctcagggcctgtgctaggttttcttctactttcactcttccatctccccactgggtgatcacttgagcctacatttaccctcagtactcgaagacccccagtttccaactcaacccctgtcctctttcctgagtcccttaaatttattttacttattgaacagacactgatggagcacttattgtgtgccaggcactgtgctaagcacctgatgaatattaactcattgaatgctaaccacgaccctgtgaggtagatattattagtattcctttttacagatgaggaaattgagacccagagtggttatgtgatttggccaaatagtgggggagtctcagaaacctgtgcggggattgtgtctgtgggtctctgtcatcccaccctgcaggaggtaaacatcattgtgagggtagtgcccatgccagccgtgctcattcttgtgcacctagcacccagtgtattgcccggcacacagtgtgagctcaataaatgtcagaattgtttaattgggtttaatttttccctatatctaagcagcacccctcattattctattctctaccataaaaccctacatgaggatctcctcgagtttctctcagtctgctattatcctctttgttaatttatttgttataatgtaggctccatgaaggtagggagttgggtctggtttttttttttttggagatggagtttcgctcttgttgcccaggctggagtgcaatggcgcgatttcggctcccaggttcaagtgattctcctgcttcagcctcctgagtagccgggattacaggcatgcatgaccacgcctggctaattttgtatttttagtagagacggggtttctccatgttggtcaggctggtctcgaactcctgacctcaggtgatccgcccacctcggcctctcaaagtgctgggattacaggcgtgagccactgtgcctggcgggagttgggtctgttttagttactatcatgcttccagcactttgagtagtaccagatataaaataagttctcaaaaatgtgtatagaatgaatgaatggggattaaataataatattggctaacattaattgggtacctactgggttaaggtatgtatatacacctgtcttacttttgtatcttgtttattgcctgtcccttaccccttcgctggaacagagccagagggccacagcctatgtctgccttgctcaccacatagtcctagagtccagagcagtgccaggtacaaggcaggtgctcagtgatcccagtggatgtagcctcgaggtgggagctgggcaggagctacttgcggggggaggtattggccggttccaccctgccccttcctctcccaggtctgttggtatcccagggtgggagcacacctgaaggggtactcgaactcgacctcgatgctgaggtcactctcggtcttgttggcacaatccacgctcagctggagctccccactgtagctgccgcatgtggcaaaggcgaagatggcgaagaccttgggcagcagggatggggatggccacagtgaacctgtgtgcatgtgggagggaggtgccctcctctggacagatcgggggcccagcacaggcagcagcagatggagcagtccccacccccaccccctaatcagggctcatcgggaccaaggacaagctgattacaagggtatggctgtctcttcctgtttctctctctgtgtctctctctgtctctgcctttccatgctgacctccctcttctctgtttgtctctgttgttctctgtgtatctcactgtgtctctgtttctctcggtatctctgtttctctatgtgtctttgtctttctcagatgtctctttgtctctctgtgtctctgatcctctctgcctctgcctatctgatctgtcgatgtctctttttgtctcttttttctctgtctgtgtaagtgtatgcctgtatgtctgtgtctttctgtttcttggtctgtttgtctctgtctctctgtcctgtctctcactcggtctccggatggttctctctctgtctccctcttgcctctgtgtgttggtttctcttttttctgagtgtctctttctctctgtgtctctctctccctcaccctgttttcctgcctctctccctgcgtctgtttctctttgcatctgttttctgtgtctcctttttctttgtttctgtttgtctcttctctcttatgtctgtatctcttctcatctccatatttcttttttttttctcagtatttccatctctgtctttatcattccctgtccctcattctctctgtcaccttcactgtctctgggtttctctgactttgcatctctcacccagcatctgctacaggctccacctcccccacccctccctcacttcaagagaggaggtaggacgtcacagtctcccacttcacaacgggggtaccctcagccctatgtgacgtcacagctcatctgttttctggcttcagacccctgaaacctcaccctggagcccaattcccccatcccctacaacccccgcactcatccctggctactcgcccctactccacccctgctcttctggaccccatgacctccctctctccctgcactctgccccaacagcccggaccacactcacccattgcagcaccttcacaaagccgaggggctccttgaccacccggaactgacccccagccaccagctgaggagagaaacagtggggaaggggtggggttgttggaggtacagggaggtgagcggcaaggctgcccatcaatgaccccaggggatggagcatgtgacctcggggagagggtgagaaggagaaagtgacaccttggggatggtgtgagccccagggtccaaggactggtgggaaggtctgaagagatggtgagtcagatggcagaggaagtcgggggtgagggagatggggatgaggtcaggactagttaaggagggggagcaggtttgaaacgtaaaggcgagtcggatggggaaggggttcgggtagagaatggggatggagtggggtgcattcgggtgggggggttgtgatggtgaaggtgagtcataacggggcaggagtcggtttggctcaggtgggggaagggtctgcaggggtaaaggtgtgttagacggcggtggcggtagatatttgaggtgatggggatggggaagggttgggactgattgggggtgagtttctgaggtggcaaagacgagagacatggcggagagggtctggactgattaaggtgggggagggctgggacacggcttcagtcgctatgtgttgggggtgaggaggctgggggttttggaaggagtaaaaccggattgtcccctaggtgtgctctgggggaaggggtggtcgcctatgggggtacagtctctgtttgggaggggcgggtgccagccctctcccccatccccgcccccacaccttctgtcgctctatttcctagcttatccgcagcaccccccatcttccttccactctcccctccccttgtcccttgccctcactccagcccccaggcccctattcctcccctcgcggtcgccagtaataaacggggctccgggggcccccgctgcggcagtgaggacggccctcgctgcggcaaagagcgcactccttttctccacctcccccttcctccccttcacctgccgcagacccccatccccagcgccggggaccgggtctccgctgccagaccctggccaccacctcccagagtcggctggcctgagcgacccggcctaggcagccgggcggcggcgggctctgtccacggtgctggagcgcgtacctgattcaccacgtccatgtccgccagcagcagcatcagcaatgcagggggc

SEQ ID NO: 2326 - DNA, 4657 bp, Homo sapiens
caaaactcgtcgctggctgccctgcgtccacccggccgactactggccatggagccgcgcacagggggcgccgcgaaccctaaggggagcagaggaagtacagggattggggatgttggggaaggacagagcgagtcgccgccacccccgtcccgcctgtctgctccacaccttttccttctgacaggtggtaaacagagcggctctggcgcccaagtgaaggtggcagggggcaggggcccagcgatggaggctgggctggaggtcccctacccacacccacacacgagggaaagggccgcgcaccagagcaggggaggggctctcaggagtctccagggagacgtgcagatgtgcggggaggggtctgcccgtggtcactggggacacctgggcactcagggtcttagtgaactggggggaggggagctgggggcccctggggacctgtggagggggactctggaggtatgtgggccatggggggaacgggccctctgagggaattcatgggggtagcagcggttgcctaggatacttagacggggaattgggggttccggggctacggcgtcaggccgtgttctcccaggatatctggggaaatggggtcccctgagatatcgcgggcgaagagttgggcatccagggtgattagggggcagtcgaggacctcacggggtgttcggaggtgtctaggactattgcagtcaaacagcgatctccagggacaccgtgggagcaagcgggggtgcaccggctacccgcgacggtcggggatcgcgtgaggggagggacagcagtgacctccgaaactatcgagggagtggccaggggtcgccgggtatcctgaggggcatttctaggtcttcgagcgtccggaagcataggggttggccgaggccgagggtcggcgttgacctgtcccctcttgcgcgcaggccgcggcccctccccgctcgcgggccctagcgcccggcagctcctggcgcggttggacgcgcgccccctggcggcgcgagctgcggtcgacgtggcagcgctggtacgcagggcgggcgccacattgcgcctgcgccggaaggagggtgagtgactggcgcagggcctccgctgggggagggttcggagaggagttgggttcagtgggacaggcctggggggtcagcagctactgccctgtcttgggtggggccaaggggcgcgacttggggcggggatcggagggtgcttcgagtgggaggagccttggggttattctagcatattccttgagggttattgcagtcggcgagggctagattagatgagagtgcggaactggacccccgttctggcggcggtcctttttgaggaggcagggcctggagagtgcttggggggcgggcacgcagcgaaggggcaggcctgaaatgtgagtcacgggggtggagcctatagtcccatgggggcggggcttgagatgtcaggaatgggatgagggttagaggctaattagagggcgtgctatggaaggttcaggagccaaattttggagtagcattctccagggtgggccgaatggtgttgtttgagggatgtgttctgcgtgttattagagggagataggaaggcctggaagattattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtgagccctgaagccccttccactggtaggtgctatccctgcctttgttggggtgctctccttttgcctttccaacacgactgcattgcactcctccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttggtgggtttcccaagggagagaagtcagagatcagtgaggagaagggagaggttcacagagtggagaagctgagattctgggtgggaagggtttggtggtctctgtggggagggtctgcaagaggtcatggtattctcacaagtaggggcagggaggggtacagggtcccaggataggaataacgtaggggcagggaggggtgtcagtctcgaggataggaatttcagagggtgggttttccaggtactggggggagagaagggaaggggtctaggataaaagcaagtgtttggaaggaagggtcttagttctcagaggcgaaggcagagtggatcttagccgggggaaaatgggatggggatccagagggtagggggtctagttctgaaaaacaaagggtcggtggtttgggagtcaacggaggtgggatgagagaggagagagcaggggctcctagatgagcggggtttgatttcctttggagattgtgggaaatgatttctgaggggcatgttctggatccaggaggggaggggtctcgggaaaggaggtgtcggggttgtgaggggtggtgcccatcccagaacgcctgtcaagggagatttctctcaaggtcagggtctcatctcccgcagcctttgggttctcctgtccatcctcagccaaaggcctggatttcccttccctacttcaccacccaatctaatccgtagtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcg

SEQ ID NO: 2327 - DNA, 4657 bp, Homo sapiens; identical to SEQ ID NO: 2326

SEQ ID NO: 2328 - DNA, 15062 bp, Homo sapiens
cctcacatccggcatgcgccgtgctcgctcacagaactacactttccaactctccccacacgacccgtgacactctgtggaccgcgagcacggagcagggtttctacagctgctccccactttctcggacccggtcctggacccagcccccgactccgacacggctccaccatggaggaggcggaccgaatcctcatccattcgctgcgccaggccggcacgtaaggacagagcccccgcccacccccgaagcccacatccgggactctaaagcccaggaccccgtttcccgggaaccttaaaacccgggatcctgacattcagggctccaactccaggatcctaagaccctcacccccttacacacacacacacacacacacacacacacacgcacacacacacacgcacacacacaccgccctccctgacaccgacatcagaggcctcccaaatcctttaaccatgatatttggtacacccaaagctctgggacccagacaccttgagacgttacaaccttgaaacctcaagacccggaaccctgtaatctggggaatcttaacatcagttccctgagaccctgttatctggagaccctaagacacctgtgccctaagaaccagggagcgtaaaaccccaggaccctggcactcggggactccaaaaaatccctggaccagatacttgggatccttcaaactccagttccccaaacacctggggcttaaaaaaacccaggattctttttttttttttccttttccgagatggagtctcgctctgtcgcctaggctggagtgcagtggggtgatctcagctcactgcagcctccgcctcccaggttcaagtgattctcctgcctcagcctcccaagtagctggtattacagccgtgcgccaccttgcccggctaatttttgtatttttagcagagacagggtttcaccatgttggtcaggctggtctccaactcctgacctcaagtgatctgcccgcctccgcctcccaaagtgctgggattacaggtgtgagccaccacgcccagccaaaaaaacccagaattctaaaatctgacatcagcatttggtcaccctgacgcacgaagactcctccgttcagaggccctaaaaacccaggatgccaacatctagggagtctgatttttgtattgcttgaaactaggtggtcttgatattcagggatcttgatacccagggaccctgacatttggaacttctgaaaacagcagcctcctaaaatctagtcttctcaaaactctagcagctcaatatgtatgcaaagaacatactatctgggaaccaagaaacccagagattgtgccacctggaccctttcaccttcccagactcccaaattttgatatttttctaaactgagttctcttccacccaccattctcctactccaagatcttaggacttgaggatttccctagttcctggttttccaaatggaagtcacagtcaccaacatccaggatctgtctgaactgtaggcatcctccctgccccgaccctggtactagtgtttccaaaaggctgcagggctcagcctgatccctgttgcctgactattcctgtgatcaagctggtccccttcttcagggcagttcctccagatgtgcagaccttgcgcgccttcaccactgagctggttgtagaggctgtggtccgctgcctgcgtgtgatcaaccctgcggtgggctctggcctcagccctctgctgcctcttgccatgtctgcccggttccgcctggccatgagcctggctcaggcctgcatggtgagtggccctcctcctaatgcacacatcctctttcttcctcttttacaaagtaaccaagttcctttgcaacacttgcctttcctctgcaacacttgcctttcctctgcaacacttgcctttcctctgtcatttttcctgcggcttagttttcattagtggttaaggctgctgactgtactgccaaactgcctgagtagtttagatcctagccccaccacttggtaactgtgtgaccctaacccttctgggccccagttttcctatttgtgaaatggagatgataaatgtagtgcttttatgaggagcaaatgagtttatccagtttgcacctgggctgctcctggcttctatgttttaaatttagctgcaaaataccacccccaccccatagtatccatttcctagttccagaaaatactctgtctgggtcatatactcctaaactaatcactctgtgctctgattggcccagtctggatgacatggtcattccttttttttttttttttttgagatggagtctcactttgtcgcccaagctggagtgcagtggtgcgatcttggctcactgcaacctctgcctcccgggttcaagcaattctcctgcctcagcctcccgagtagctgggactacaggcgtgtgccaccacacccaactaattttcatgtttttagtagagacggggtttcaccatgttggccaggatggttttaatctcttgacctcatgatccacctgccttggcctcccaaagtgctgggattacaggagtgagccaccgtgcccagccttttcttttctttttttcttttttttttttttttgatgtgaagtctctctctgtcacccaagctggaatgcagtggcgtgatctcagctcacggctcactgcaacctccgtctcctgggttcaagtgattctcctgcctcagcctcccgagtagctgggactacaggcatgcaccaccatgctcagttaatttttgtatttttagtacagacggggtttcactatgttggctaggctggtcttgaactcctgacctcgtgatctgcccacctcggcctcccaaagtgctgagattacaggcgtgagccactgcgcccggccgacacggtcattcctataggacactgtgattagccactccttcaggatcctgtggagttgggataaggatgattacccaaagaaaggcatgctggttacccaaaagagtgtctgctatattacctctgtgggaaccacatatcctgcctctgctaagagcaattccaacaatgtctctgtgacagaataaataaagtgcttttcttttaaaaaatattttaatttttttagaggtaagtgtcttgctatattgcccaggctggtcttgaactcctggcctcaagagattctcctgcctctgcctcactagtagctaggactataggcacatgccaccctgcccgagaatttttaaatttttcgtagagatggggtctcgcttttgtagagatgttgcccaggctggtcttaagctcctggcctcaagcaatcttcccgccttggcctcctgagtagttgggactacaggcgtgcaccactgtgcctggtaaagagccattctgatgaaacactcacccattcccagtatagagctgagtccaggagtccagttcctgtattcaagagctgcaagtaatgccactccccctggctcactcactctgtgactttgggccagtcttttttttttttgaagcccaggctggagtgcagtggcacaatctcggcttactgcaacctcctccgcctcctgggttccagcaattctcctgcctcagcctgccgagtggctgggattacaggtgtctgccactgtgcccggctaatttttttgtatttttagtggagacagggtttcaccatcttggccaggctggtctcgaactcctgaccttgtgatccacccacctcagcctcccaaagtgttgggattacaggtgtgagccaccgcgtctggctctcttaacctttttgaggctaagtttccacatgtgtaaaatgggtataagaattgtagctactgtatagggttgctgtgaggattaaacatgagttaatgtgtgaaaagctggttataataagctttgcataaatgggattactattattggataggtccgatctggaacctgtgaatacatagtgaatggaaacactttgaactgacccaggaagtatatggtggtggagggacgatagagtaactaccgtgaaaactttcatttagatataggggactgggtggctagagttgttaaatttgggccttgcttatgcagtttctgtctcttagcaacaggtctcagagctccatccatcccttcgctctcaggttcacccagctctcaggagttgtcacattgttctctctggggctcttggtggccttatgaggcaggcagtctgtcccctggcccaggactgtatgtattcttaaggttagcacttaataggggggaagttatgtcttctgtttgcagaggagagtacacagcaggaggtgttgaggtgggggctcaggcttcctgcagttctctgttcttccctcagtgctgtctctcttggattttgttcacctgcttttgcttacattgattttagtgggggttagtgactatggcttttccagtggccaggaggtacatgtgggctgggcacgttggctcttgcatgtaatcccagcactttgggagtctgaggtgggaggatcagttgagcccaggagctcgagatcagcctgggcaacatagtgagacccccatctctacaaaaaataaaaaaaaaatagctgggcatggtggcacacgcctgtggtcccagctatgtgggaggctgaggtaggaggattgcttgagcctgggaggtccaggctgcagtgggctgtgattgcgccactgcactctagcttgggaaacagagtgaaaccccatctccaaaaaaaaaaaaaaaaaaaaagactggggacggtggctcctgtaattccagcactttgggaggtggaggcgggcagatctcaccagaggtcaggagtttgagaccagcctggccaacctggcgaaaccctgtctctactaaaaatacaaaaattagcctggtgtggtggtgtgtgcctgtaatcccagctactcaggaggctgaggcaggagaatcgcttgaacccaggaggcggaggttccagtgagtcgagattgcaccactgcactccagcctgagcgacagagcaagactcttgtttccaaaaaaataaaaaacaggtacatatggttgtctggcccccagcagccttggtttatcagcagcaggcaaaaggagttctcttaatccagctgtgtgctgtccctgtagcccccccgcaactcagcactgccatgttctggcatcttttcttcatatgccctgctcctggcaacagtttctgcaccttagccacctccatattttggcaccttccccactcctggaatgagtttctatatcagtcacagctctttgattgcatattgtggaaaaaatccaaagtaaaataccttaaaagccagtggttatacttatttgaccttgagcctccaaaataaatatatcttgcattgtgacccagtatactcctaagtatagaataatgatggcttctaagtgtactctgtgccaggccctgtggtaagtaacatggtgttaactcatttaattctcaggacaaccttctgctatatgtactgttggtataccctctttcagatgaagaaagtgaagcacagagggattaagtgatctgcctgaggtcgtatagttggtaagaggcaaagcttgggtttgaatccaggaagtctgctttcagagtctatgcagttccaaagcagtggcaactctggaagaaaaaggctttcctaggccgggtgtggtgattcccacctgtaatcccagcactttgggtggctgaggtgggcagattgcttgagcccaggagtttgagaccagcctggccaacatggtgtagccctgtctacactgaaaatacaaaaattagccgggtgtggtggcatgcacctgtaatcccagctactcgggaggctgcgtgggaggatcacttgagcccaggaggcagaggttccagtgagccaagatcacgctactgcactccagcctgagcgacagagcgagaccctgtctcaaaaaaaaaaaaaaaaaaaggaaaaaggctttctttctctcctggcctgtttcctcagtccccatcagaaccctcatgagtccttttgttctgagctattgtgcttctggtctttttgtcctgtttatttttaggcactctttctataataggtagatttgctctttacctatgatatgggctccaaatattttttcccaacttgtcattaacttttgactttgcttattctattttctttaaatattttctttcttttcatgtattcaaaagtacccatcttttcttttatggcctctggattttgagtcatagaaaggccagagctttaatcttgtttcttgttctctgtagcgttgactatcatcactctgtgactccccccagggcccagaggccttggggagctgggggaggttgggagggtggtggttagtgagaaagtgggagcgttttcagcctaggcccaagtctcccagggcaggaggaccctgcctgcttcctgatagccgcccaccaaccctcaggacctgggctatcccttggagcttggctatcagaacttcctctaccccagtgagcctgacctccgagacctgcttctcttcttggctgagcgtctgcccaccgatgcctctgaggatgcagaccagcctgcaggtactgggtgtctgggatgtgggcgggggcggtgaggggagaggagggccttctaggggctgtagggctgagagaggtagaggtggtaaaaaggttgatgggtaggggtggcggtatgtgccttcaggagagctaggcaggaggattaggcatcagagaggggctacagggcagggggcagggggctgaggttgagctgaccccggtggtgcgttggtgcggggaggggcctccctgactcaacccctgtgccctccctctctctcacttcgctctaaccacttgggcctcctgggtgctactcaaacataccccagtacactcccgcctctgcacctttgtatcgttggttacctttcccctaggtaccctcatggttcactcccttacctctttgaggttaacctcctctccgcagccctctcctgatccccacctggctgcagtctggatggtattcaggatcctattcatgatctctctcctctgctagcttgccggctccctgagggcagggacctttatccagtttgttccacgaagtagccctagtgtctagaacagcgacctgtacatagtaggtgctcggtgtttgttgaatgactgaacgtgagaacgcaagctggatagatgtgtatctctggatgggggtcaggagtggaggctggtctcctagggtatgcccttttggatttgcagcattgacatctgattcacttcctccctatcccccataggtgactcagctattctcctccgggccattgggagccaaattcgggaccagctggcactgccttgggtcccgccccaccttcgcactcccaagctgcagcacctccaggtgagacccctgactcccatggatcttctcttgtccccgtctgggtgcccagggttttggccccctacccctggcaaccctcatcccacttcaccctggagattctgagcctgctctcccaccagggctcggccctccagaagcctttccatgccagcaggctggtcgtgccagaattgagttccagaggtggtgagcatgaggctgtggggaggggtgaggaggaaggtgggggggaacctcatagcgttgccatgcggcagggccagctgactctgttcctgcctccagagccacgggagttccaggcgagtcccctgctgcttccagtccctacccaggtgcctcagcctgttggaagggtggcctcgctcctcgaacaccatgccctgcagctctgccagcagacgggccgggaccggccaggggatgaggactgggtccaccggacatcccgcctcccaccccaggtacagccagatgcctggctccctgctgtctgggctgctgctcactgacactcccgctggtcctctgctctccttccccactttgtccctcccttccattgtttcccctctgtgtgtgcttacctagctccccacctgaaagaacactggagtcagaaaaaaggagaacctgggacaagtcagtatccctcctcagagccttggtttcctgtgctaaaatttggggtagtaatagtgctctcctctcagggcagtagttagactgaataatgtgcttgagattcctggcaactggagcaatccagattggctacctgccttcatcattcattaattcattcattcatttggagtcttgctctgtcacccaggctggagtgcagtggcgtgatctcagcacactgcaacctccatctcccgggttcaagcgattctcctgcctcagcctcccaagtagctgggattacaggcttgcaccaccacacctggctaatttttatatttttagtagagacagggttttgccatgttggctaggctggtctcgaattcctgacctcaggtgatctgcccaccttggcctcccaaagtgttgggattacaggcatgagccaccgcacccggccctaatctttctctgtttctgcacttgtcactgatgttcatttttctggtttctaggtttttgcacaatttctgcctgtccccattattctagttctgtgtttttgctgctcctctttcttacctctctgtctcctcgtttctgtactgaattcctctcttgctctgtctatctatctgttcccccttctcctctgtctacttctttatctgtcccctcttcttctctgtgcacctttttatctgtgtccccttctgctctgtccacctctgtatctctccccttccttgctgtccacctatatatctgtcacccctctgcctctgtttacttcttaatctctctcctcttcctctctgtccacctctgtatctgttgccccttccctctgtccccttatctctcccttcttcctctctgtccacctctgtatttgtccctcctccccttctgtccatctctttatctgtcctctcttcttctttttttttgagacggtgtctcgctctgtcacccaggctggactacaatggcatgatcagggctcaaggcagcctcaaattcccgggctcaagcaatcttcccacctcaggcatctgagtagctgggtctacaggtgcgtgcgcccggctaatttttgtattttttgtagagatggggttttgccatgttgaccaggctggtctcgaactcctgacctgaagcaatccacccaccttggccttccaaagtgctgggattacaggcatgagccaccatgccgagccccctcttcttctctgtcaacctctttgtcccctcttcttctctatccatctctgtatctgtcccctcttcccctctgtccacttatctgtcccctcttcctctgtccacctctgcatctgtcccctccttctctctgtccacctctctgtcaccctctccctctgtccatttctttatctgtccccttttcctctctgtccacttctctttttccctccctccattctgctctcctatttctgttccctcttcctctgtgttcacccaggtatcagtacccctccccttctgtccacctttacatctgtcccctcttcctctctgtccacctctgtatttggcccccctccccttctgtctgcctctttatctgtctcctcttcctctgtgtccacatctctgtctgcccctctttttctccacctctgtgtcggccccctcctggtctgtccacttttttatctgtcctctctttctgtcttcacctctgtgtctttttacatttttatttttttatcattattattattttttgagatggagtctcgctctgtcacccaggctggagtacagtggtacgatctcagctcactgcaacctctgcctcctgggttcaagtgattctcctgcctcagcctcccacatagctaggactacaggcatgcaccaccacgcccagctaatttttgtatttttagtagagacagggtttcaccatgttggccaggatggtctcgatctcttgacctcatgatccatctgcctcggcctcccaaagtgttgtgattacaggcgtgagccaccacgcctggctgtctgtttttgtttttatatctgtagtaattttcaaacataaatgtagagagaatattctagtgaatcctatgtaccattttgccaacttttcttcatcttttctctcccaactttttctttgttgctgtattattttaaagcaaatctcagacatcatgtcatttcagctctaaatacttaggactacatctcttaactcataaggacattcagttttcaaggtaaccactggaccattttcatggctaatgaagttaacaataatatcttgtgggtttttttttgttttgttttgttttgttttttgtttttttttgttttgtttttgagacggagtctctctctgttgcccaggctggagtgcaatggcgtgatgtcgcttcactgcaacctccacttcctgggttcaagccattctcctgcctcagcccccaagtagctggaattacaggagcacactaagttttgtatttttagtagagtcggggttttaccatgttggccaggctggtcttgatctcctgacctcaggtgatctacctaccttggcctttcaaagggctaggattataggcatgagccactgtacccggccaacaatgatatcttaataccatccaatacttgagttcataatcagattttcccattatcttgaaactctgttgtccctctcttgcctctctctctctgcctctttctgtgcttggtacctttgattccctgtctctgccctgtcccccgatatcctgtctatgcttctcttggatttgggggctctaggcccacccccctctcttcccacatccttctccagcatggggatctagtgggtggagagaagtatgtctgtgagcaagaggagacccctgtcctcgaggagatcccaggctggtggagcaggagagtagagcagggcctgccttagtgggaaggctggagggtgggggtgacttgtctgtatactcttgtcagggggtccttggaggaggcagggccttgggtgctaggtgggcccctacaccttcctgcttcccccgccttttctccccaggaggacacacgggctcagcggcagcggctgcagaagcaactgactgagcatctgcgccaaagctggggcctgcttggggcccccatacaagcccgggacctgggagaactgctgcaggcctggggtgctggggccaagactggtgctcctaagggctcccgcttcacgcactcagagaagttcaccttccatctggtgggtgcgcctgaggacatgagatgtgtggatgggcgtggcaggcttggagggtggctttttgtgtcagcaccacacctttatccacacaggttcctgtgttcccactggacaggccctcgccccactgtgggatgggtacccagaggggtcccctagcttattagggacttgactggagaaaatgtggataggtgggaaccatgcaaaggtgtgggggtgttcttggggcaacaccccctttcctcaggcagtttcctttgagcatatcttctgtcctaagatgttcactctgagggccccccatccttctcatgggcatttgaggcttgagagatggggcaggtgggtaggagctgtgacagggtcagggagatttctccacgagcaagcactctggcccgaggttgcagatggtgcctttacccacatagtcacagtctggccaccatcggtgcttcagtgggcatgcatgccgcactgggggcagttctcaggggaggctgaggctgggccacgtgaggaagggccttccctggcagccaggatgcccctcgtcactccccttaggagccccaggcccaggccactcaggtgtcagatgtgccagccacctcccggcggcctgaacaggtgagcagagtggtttggaggggggtgtcccaggcccttgcttgtctactgggcctgacaccccaaccctgactggcctgggcctcccaggtcacgtgggcagctcaggaacaggagctcgagtcccttcgggagcagctggaaggagtgaaccgcagcattgaggaggttgaggccgacatgaagaccctgggcgtcagctttgtgcaggtaaggggcggaggaggggctgcgcgttgggctaggtcagaaggagggcctcggggtgtgagggactagatggggcaagaggtgctctgtagaggtctgcacatggcagaagggttcctgggagccattagggatctgtgggcctcttgagggtggctatgagaatcaggccagggtgagggtctgtgggcatctatggggcaccgcgggtctgcatgggcaggggattgaggggtcctcggagggtctgtgggcatctgtggggtacccacgggtctgcatggacaggggattagggggtcctcggggtccttggcaccagcgtggagctgttagagaggcctgtgggggccacaggggtgtacagtcatctgtggagctccatgggggctgtggcatgtgactgggtatccaccggccaggcagagtctgagtgccggcacagcaagctcagtacagcagagcgtgagcaggccctgcgcctgaagagccgcgcggtggagctgctgcccgatgggactgccaaccttgccaagctgcaggtggggttggggctgtagctgggcggagaggggcagggtggggtggggtggggttggagggcccagcctgtgtgacatgtacccatcccccaccagcttgtggtggagaatagtgcccagcgggtcatccacttggcgggtcagtgggagaagcaccgggtcccactcctcgctgagtaccgccacctccgaaagctgcaggattgcagagaggtaagcagtggggccctgggctgtgggcgggccagggcaggctcggtccctctctagggggccatccctatgctctgctcactgtcttctgcctgtgggctcatggcagctggaatcttctcgacggctggcagagatccaagaactgcaccagagtgtccgggcggctgctgaagaggcccgcaggaaggaggaggtctataagcagctggtaaggcctgtgtgagggacctgggtagcttaggagggtggggggatggtcctggggcagtgcctgctatatccctgcctagatgtcagagctggagactctgcccagagatgtgtcccggctggcctacacccagcgcatcctggagatcgtgggcaacatccggaagcagaaggaagagatcaccaaggtacactgccagggccatggagggtgggtcatgtgggctgtcaggcatagtgtggccgcacagggacctcacaccctcaggcagagctgtccagtcacactctaacacagaatagtcacacacaatccatcccagtcacccctgacacagtgacacagtccctgtctggtacacatgaggaccctccactgctagccagcctgccccaggcaggggctcatggctgccatggtgtctgccagatcttgtctgatacgaaggagcttcagaaggaaatcaactccctatctgggaagctggaccggacgtttgcggtgactgatgagcttgtgttcaaggtgtggggcaggttgggcgggggtgagtggggtgaggctgggctgctgccttgtgcatctgctaattggctggctggggtccagacccaggccctgtgcgaggctggaggtgcactgatacccagggctggctttgtttcatggaggatgaagctagtggggtggtgggagagggtggccttcttagggcatggagatggtcaagggcagcccactgatacctttgaggtccctgtgtctggtcaggatgccaagaaggacgatgctgttcggaaggcctataagtatctagctgctctgcacgaggtgaggggagacatgtgcctggggtggggctgctgggggtgggtgggactgggtgcaagccttctgctcctgttgtccccagaactgcagccagctcatccagaccatcgaggacacaggcaccatcatgcgggaggttcgagacctcgaggagcaggtgaggcctgggggcaggatggggagccaaggcgggccggggggacagttcctcaggttatgctgacagaggctgtggagccacacacagccgatggctggacacccagccctgccccttagtgcctgtgacctgggacaggcaagtggcctactgtgagccccagcttccaccccaagggccctcctgtctgcctcccagggccatgggcagaggcttcagcttaaagatgtagggggaatcctgccacatggcgaaggatgctttgggtagagggaacaccacacgaggcctggccatgggacagagcaggctgttggagttggtgggaggggcccagagtggctgtgatgggggctggtgagcaggagctgggaaaggggctgtgtgtgctgagggggcatgtgttcacattgcctcagatcgagacagagctgggcaagaagaccctcagcaacctggagaagatccgggaggactaccgagccctccgccaggagaacgctggcctcctaggccgggtccgggaggcctgaggagccgccggcagaggtctctccccagcctcaggcagggatttggggtgctggaggcagtggccaagcacatgccctagctacttcctccgctgtccagttcctcctgctgcggccttggacccagacccctgcccactgaccgcaacccttatatggggtgatagtccagcatgtggggagctcggctgcagtttattggggacggtactgtgggttgggggccttggatcccaaataaatgagtagttcctctgcagtctaa

SEQ ID NO: 2329 - DNA, 14393 bp, Homo sapiens
atgtggggagctcggctgcagtttattggggacggtactgtgggttgggggccttggatcccaaataaatgagtagttcctctgcagtctaagctgaggcatggatcagggctcagggaatgggagtgaggtgagtggcaggggagacacggggtatttttggcaaggcagtgtgtgtggctgtgtgtgtctgcacgggactcaagagacccactggggggctgtgcgtgtgcatatgcgtgagatacacaggtgaattctaacaggccgtgtgtgtgagcgagcacgtgttgggacctcagatcctgagggtactgacgctgcttctgtgtaggcctctgggcacacccctgtgttgacagtgcccctgtgggccctgaggctggctgtgggtgcgtgccttggggtgtgtgggttgtcagggctgtgcttgtgtgtgattgtgtgatgatgcagctttgaggttgtttgagtgtactgaggcaggctctctgtgttttggggtttgtgttgagtgagggacaggattgtgacattttgtgtgtctgtgtgacttttccagccctgaagtaatctgtgcgagcagctgaggcaggctctgtgtggctggttgtgaaggctctgtttggctgcagggctcgactggggggtgtgtctggggcggaggtgggggctggggccaggaccggggcccctctgagcagccttggggcaaaggatatgatgggggagggggtggctgccagcgggggaacaggggccctggcaggcaagacagtggaaacctcacttcttggtccctgtgggcacatccagggcctatcatccctgcccccaccacctctgcctcccaccagtttggcccctgttcgtccatcctcctttccttgatcttgaggtcaggggccaggtgtagggttggaacacctgctgggcctctggctccgtttcttgcggaactccagctcatccacggtccacacagcccccttctcgctctccacccgcacaaagcacttgtgcagactcaggttgtggcggatggcgttctgtggaaggccggggacagggagcaggtgggcgtcaacctctgaggccagcagccaccaccaacaacccacatcccgttcctccccaatgtgcctatgagcccagacccaggcctgcccactttgagctgcgatggcacttgaggccatcccagtcaccgccacctcagaggagctcaccttccaggtggcaggatggtttctgaagaaggcaaacatgcgtgtgaaccagtggtagatctcattgagtgtccgctgcttctctggagcctccaggatggcctggaagttggggggtggggtaaggggcacattccccaaacttggggtttagaggggctatgacctaccccgagccatctgacatgggggcggaattgtaggggcaggtaatcagggacaggactagatgtggggtgaagcatggggtcaaagatggggttagaaaaggggtgaagtgtcgggttgggcagggttagatgggtgtgggtatggttgttctgggattaggtaagggatcaggactgaggttgggagtggggtcttgttcagggctagggctgaagtgaggtgaaaggtctgggatggagttggagttggggttctctgtggaggtgacatttcagggttggggaaggtgaagggtcagaagtggggtcaaggatttggaaggggtaaagggccaggccaacttaagggtcagggaaggggtgggttaagagtcaggctggggtggactcaggtggggggtctaggggtgagggatgggatgacttggctttaggtcagaagccagagatggtttgaattatcgagtatcttacgtgtcagggacatggttaggtggttaggctcagggcaaggatgaggttagttgtggggttcggtgtggagtgaggctgagggtcagggaatttgatcagtttggattcaggaatgggattacagagtcagcgatgatgattgcagtgaggctatcagtcaggatggggctaggtcagggtttcagttcagagacagtcggggaatatctggtatcatgtaggggtgaggttcaggtttggggttaggtgtggcgctaggatgaaggttctgagaaggcattggggaggctgagatgaaggagttgggatggggtgatgaagttaaggatcaaatgggtgttacaaggaaaggttgggaatggtgcccagttgggggtgtattgacatactggggtacgttggggccagggaaggagatggggttgggttggcataaaggctggggaaggagttagagtaagagctggggtacgtttagggcaaggtgcagagatggggttagctttaggctattttatgggtccaggagagggttaggtatggggctgaggtggacatctggaaaggggtaggtttagggtcagaatttggcatgctctggcctggatggtggtttaggtttggatttgcggacaggtttggggtgaagccagcatgaggggtcacatttgaggcacggcttggggatccttggggctggggcttgggaatggaggaacccactctgagggcactcagagggagacaggagtttgggaggcaggtcccccaccccatctttgtcttcctcctccttggggccgagctgccctgcttacccagcggatgagcgtggcgtaggtgaaagggggtcgcatgttgtggaacttgaagtagtccatgttgtggaggaactctgtcagagggtggggatgaatcaagccccatgcaggacctcctagctagctccctgtcccctccccctacaaggtgagtctacaggcctgagatctcaccgtcaacacccgtgtccacgggcacaggtactgtttgctgagcacctgacataagttgtatcatttattctttgcaccacttctgccaaaatagttctccccgaggttgaaaagaagcggagtaacttgcacaccaaaggatgcaagaggttaaatggcagagccaggatgacagtcaaggtctctgatccctgctaagcccacaggccaggcctggtggagagcagtggataggtgagctcgggcgaatccaccccgattttccttggtcaggggaggaaaggaggtgctcctggaattacttagcagggtccctcccttctgatggccgaatatagtagctggagtccagagtgggtgaggcatggccccaatccccaagggagtcagggctaggggcccgacactcgagaccatatggggggctttcaggccacggacatcccgaaaggaagcttttgtgagcggatgcattttcccaaaggctgagtggcggcagctgcagtggtggtggtggtgggaaggggcagcatggagctcctttgcaccctccacccagagcctgtcaggattaggagcttgggggcaccgtgtagtgcaaggaccattcttacctgggaatgtgctgtttccatggctaccccacaggtgcctccggacagcaaacaggctgtcaggggcctcccgggggccagaccaggctgggacgacagggccttggctgccagcagctacgatgcagcaggagcccttgtcggatgatgcctgggtgagggggagaggctggtgacccagaggcttaaacttcccactttttactttctattttatgttttttattttttttgatactgagtcttgctctgtcgcccaggctggagtgcagtggtgcaatctcggctcactgcaacccccacctcccagattcaagcaagtcttctgcctcagcctcccgagtagctgggactacaggtgcccgtcactacgcccagctaatttttgtatttttggtagagatggggtttcaccatgttagccaggctggtctcgaactcctgacctcatgtgatccacccgcttcagcctcccaaagtgctgggattacaggcatgagccactgcgcctggctccactttatttttaaatcagtgtttttcaaagcaaggacgccctcttctaaattccagtctgaggtggaatcccacaaaacagcatgagccgtatttattagagcacaggtgcggatgtcgtatgtggccactgatgctgggaccatgaactggggttgaatagggctctttaccacccaactgtgaccttgggaaagtcacctaaacccccctggcctcaatattcctcatctgtacattcgcatcatgagaaataaattaccaccagcaaagcgctcagaaacagtgcctggcctccagggctggcttcatgggcgtgtgacctatgtggttatgtggcaccctgtgctttgtttaatgctctgtggtcgccatcttgaaatctgaacaaggggccctgcaggttacatagctggtcctgctggcacacagcctgcatctggcaagtctggctatttgcatttgctttaacaactcaggatcacagtgtttggggatcttagagtcagagggttttttttttttttttttcttgagacggagtcttgatctgtcgcctaggctggagtgcagtggtatgatctcagctcactgcaaactccgcctcccaggttcaagcaattctctgcctcagcctcccaagtagttgggactacagacacctgccaccacgcctggctaattttttgtacttttagtagacacagggtttcaccatcttggcgaggctggtcttgaactcctgacctcgtgatccacccgcctcggcctcccaaagtgctgggattacaggcgtgagccaccacgcccagccggggtcagagggtttgtaagtagaaggggacagatttccaggtctgggcatgtttggagctggggacaggggcccctagctctcaggacctgaatgtgaggttaggttccctgcaccgtgcagacctcctccctgccccccagcagtctgagtctgccaccaccagtcctggggtcgctcaccacagatgaagccttggtcagtgccattttcccagccaggtgggcctgcatggcactcagcttctccttctccagcaccagctgtgaaatggcacaaacatgaggcctcagcctggcccttctctgccacatctttgcccaggctacggtcttccctgggagtgcccgctcctcttccttcctttataccagccctcgtcccaggtgaacttggtttctggcacatggtggacagaaggttttgcgcactatccctatcccttaccctccaccgccctggcattacctgctgctccagagactgtaccatctctctctggaggagacattgtgccctgcccttctcatccagaagatggtccgcctggcagtgcctaagtagggagaagattccatgcaggtgaccacgacaggcctggtctggctcaatgctctgaatggggagggcccagaccctctgggagttctctcctctgagccccagctcccctcccctctctacctcagtctccctctcacacccctcgttcccttaacacatgcccctcagcacctactgcatgtcaggcctgaactcaccacttgagcctggccagagtgctggagataatgttggaagtgtggtgagttgagaatgggccagggaggtgagagtgggcaaagcattctgggtggagggacggcctgtgcaaaggcctggctgcaaggaggacaggacatgtggggttgctgctaagggttgtgtgtagtgtggtgtgtatttgtgtgtgtgtgtgtgtgagagagagagaaagagagagagagagagagagagagagagagagagagagagagagagagagacatatggggggactgaggggaggcagcagcagccatctagaggagctagaactttgggaacagtggaataaggctggcatgttggcatgaggagtagcagggcaaagcaggagtgcagattctagagcctggctacatgggttcaaatcccagctctgtcactcaggaactgggagattttgatcaagacacttaacctctttggcctcagtctccttgtctgtaaaatgggggtaaataacagcacaaacgtttcttattatacatacgagaaaactgaggtcgagagaagctaagtaatttgtccaaggtcacacagccagtcagggatggagctgggatttgaacccacagtctcagagtttagctcttgcatcttactacttattgggatgaagcctgagctgagatctgcaccctagacctctccccacaagccagggccggtagactggcacaggcctgggccactcacttgaggaagtcctctggctcttcgaagaccttctcacatccgggccacttgcagacaccatttgccagcagtgggtaggagctctggggcacagccgaaagggtgctggggggacagagggtgtcaggggaggggataggagggcgaggatccttcccagccctgtccactgacctgtccttcctgggtgcactgggatttgggaaggtgcagagcagtgccggctccctggacacccattccaggctggccacgttgatccctgtgggtggggacagggcacctatggaggctgtgggctgggctctggagcttggcccacaaggcctctcattttgagcttcccaccctcctgagcctcgaaaaccctgactcccagggggctctgctgtccccaaagtcccaggcttctggcagagaagcttaaagacggccattcgcaggtgctgacattttgactagctttgtaaagctctgtggttttgtgattttgacattctgcatctttaaggttctgcacctgacgttttttggagggtggagtttccaagcctctgagacctgacacctttgacccccagagtactgcaattcagaatagcctacactgctcacagccaaggatctggggacttgggggttctgtgaagccatggggtacgggctgaggtgttaccaggtgggaggccaggccgggccttgagggagaagaccccagtggcggtggtgggtggtgtgaggctgatcatggctgggctctccagggggtgcacctgcagcacaggggtccgggcgtgggcatccaccgttgagagctggggggcacatgtgggctgtggttcagcctgactcggggcccctccccacagttctcccacctgctccctcctccctgcccattcaccgtccatacctggtgcatgaaatgtggcctgtcctggaggagtgcctgtaagtggggcaaggggcccagccgtgccccggagggtgccaccatgactaggggcagtgtgggcagctgggcagaaaggcaggtgggtgagaggccatcctgatcctcactgttctgtgtctaattcaaatactctgcactgcaagcccacatggtagatgctatgatcatcccccttttacacgtatggaaactgaggctcatggagatcgagtaactttttaaagatcaaacagctaataagttgcagagctggcctcagccctgtcacctcacctacttggccccagtcctcttctcttgtcacatggggatggggacacatagctatgctcatgggactacaatacggcctcctcctctcctgagacagggattgggaggtcggggagagcctccaatctctgaggcctggcaggtggggattttcttggccctgcaacatctgcataagtcacagacttgcctgggacccagaaaccacttcctgtgccccagccagcccccctcccgcccagtgccacagtaaaggtcggcacctgtaggtccaggtaccccaccctgcctgccccatcctgggcccagggcctcacctgcagctgcgatggtggcatggggttcaaggaagaagaggaggcatgggccccgcctcgaagatctcggccctggaaggttccccctgggccccgggcccccagcaggtctgaggctttgggtgcagccctccagctgggcgaggctcctggggatgggccaagggccaaggaaggggccgagggcttgccaggcctggggttgggcatcgggtccttgtccaagggcaggctgcgtagacaataggggaaaggagtcacacgtgtgctagggcggtatgagatactcgaccacctgagccacgtggacactcctctggtcaaagcaggcattggctgggacatgtcccgaggggccccatagttgcaccccagctctagacacacacacacacacacacacacacacacaccaagaacacaggtacatgtacatacccacacatgccccacgtgcagaggtccagcacctggcttgcctgcccacgctagcacagccctggtgtggatgtgtcctctatgagggcaatggttgtttccccctccacttgagagctgtttcaagcctcaggcctctagccctccctgcaccctgcacaggctgtgtttgctcatcttgccggagctggtctcggactttctcctcggagtcctattttgccccagtgactaggcatggactcaaaagattcatctggctgctgtgagtggggctagtgaggaggctattgtaacagtcctggcaagtgatgatgctggcacagaatgggctggtggcagtggagaaggcgagaagtgggtagattctgagacttaatctgaagctggatcaggagcagtgctagcagcttggatgtagtgggcaagagggagagtcaaagtgacatgggttttagcttgagcagctggaaggaccgagctgacattacctgagatgggggacatggcggggagttggattgggtgcaaaagtgcaggtgtagatagacatgaagagtctggcattaaatatgtgagtggaggagctgagggggcagctgaatacgggggtctggatctcagggcaaggaggcgagtccaggagtgtgatcatgcacggatccagcatggcaagtgacagagaggaggagagatggggtctcttgagctggggcctgtagaagcttctctacccagcccccatcagagttcaccccaatttctggccctcaagcctggctcatgctacaccccctgcctcaaatgcccactccttctcctctttccctgtccaagccacgcaagacctgctcttctattgtcctcaccttgaaagccctccacaatggctccgggccccctgctgagccccagaaccttccactccctgagggaagcactggcttttcaggatcctataatcctggtctgagaggaagccagagctggaagggactgcccagccaaccccattatacagaaggggatgctcagatgccgagttccgtagtcccatagtgacttgagaactccacttctttctttaggaagtgtttccgtgtgcacattttataaactctctggtgtgtgtgtgtgtgtgtctccatctccccgttccacctcacagcactgagttgggcacacagctgctgagagcagcccgggggagtatagaagggttctgggggagcagttgctccttcctttctttgctgtcacctcctgggggtggttgtcagagctgtggtgctgagggagatgagtgtgagaatccaggtattaagttcttagtctcctgggggcttagaacattactgcgtgagaaacaggagtgtgggtctgtggaggctccgaacaagggcctgggagagcactggtgagatgagaaggtgagtgaatgaatgaagccagagatggggtgatgctccttcaagccaagaaataacaaagattgccagcaaccaccagaagctgggggagaggcctggagcagcttctcccttatggcccccagaaggaaccaaccctggcaacaccttgatcttggactctggcctccagaactgtgagatgatcaatttctgttgctgaagccactcagttgtggtactttgttatagcagccagaacaaactaataccgatttcggtgcaaatggatgttttccaccactctggcctggcccatgtggctggcctgtggtcacttctgaagctgcctggacacttggccagagctaagaattctccccaaacacatgtgggatggcctgactcagcaaagcatagatacattctcagacagggacatggagatgatctgtctgggggtagaggacctagagggccgggctgggcagccggcttcctgcactgtctgttgggacgtccctttctgactgggtttctcagaagctgaatgggggatgtttctgggacacagattatgttttcatatcggggtctgcatctgggccctgttgtcacagcccccgacttgcccagatttttccgccattgacgtcatggcggccggatgcgccgggcttcatcgacaccacggaggaagagaagagggcagataccccaccccacaggtttcgttccgagaactggctgccctgtcctgcagcaggcttggcccaggtggggtgacatgggtgctggtggatgtggtaggtgatgtccatctggccactatgacaagcccctagctctgaagacctggcccttcttgggttgtggagaggacccaggtttgaagctctgagagtgccaggcaggctccacagatactgggacccctggggtcttcaaatagtataacaccaggacctcagaatcatagaacagcatttcttagatttaaaggatcctagaatctcaaaaccacagactgtggggtctacggtcccaaagtctcagtatgtgtaggccagtgtccctggtgtccaaactccttggaaccatctgaaagtcaggcagcttgctgcttcatagggcctcttgcctaccaggcctggaaacagagccagcctccctagggcctcagtctccctgtccactctggaacaacgttcccaaatacatggccactccgccagagatggcaacagggggaggaggaggttgaggctggtgtgcctttggtctgggcctcatggggggagctggaaaagcctcagccttcgccaatacagagcccatcatcagactctctagaggggccccacaatcaaggttttcggggaccagcaccagctctggggacacacagcctgactgactgacatgcctccatcatcaccacgctctggccaactaggcctcctgacctatggagtccggggcctcacctagcccagctcttgtgaggctgggccccacactgtgatcgtggatcgtccaacctgtgggaagttggggtccaacgtgtgagaaggcagaagggggaatggtagcccaggttccccttcccccttctgggtgctgaggggtaaactgaggccttcagttggggagagagccagaaccagggtcccacctagagtcctgagatctaggcttggatttcaactctgccgctgcatttcggtgaggccctgagatctctggtcttcaatttgcccttctacactgagcacggagaggcgtggagtagacaagggccagggcccttctacgctgtctggttaagtcattaggtgtctgcagggcttcaagttgacaattgcccctctatccaggggactggctgagagatagggatacatagagacaaagagacacacacaaagagcgagcaagagagaacaagagatagtgagagacattgagagaaatggacacatgcatggagagccagagtgcatgtgtgcgagaggaggattgcctcaaataagaacatttgctggtctctggctggttcaactgatgctgcctgaaataatcaagaataaagaagggcaaggtgccagggacacccatggctgggtattgaattgtattgcaaagcaacaatcagcaaaacagtgtggccctggtataagaacagatactggggaagagaacagaatagaaagcttggacatggacccacatatggagagaactgaatttgtgatgaatgtggcatttcaaactggaggaccatggagtatggtttaacaaatgtgtctgagataattagggagaagataaagttattgagtgaatagtcagtccattatcccaacaacccctccctgcccagtttgaaatgtcaccatcatcatataccctaaaatgcccagatccattcaagatataagttttaacacctaatgctgatcttgggtttattgtgtgtcaggccttgtgctaagtatttactgtggttaaaaattttaatctaaacaaagactcctgaggaaggtactattataaccattgcagtacatatgaggaaatggaggtatggagaggttaagtgcctggctaaaaatcacacatagggcttggggtgacgctgggtttgtcccagacagtctggctccagtacccacactcttaacctctatagtaaatggaaaaaatgaagccataaaagagactagaagccaacataggtgaacatttatctcattttcaagtaggaaaggactttctaagcacaaaaccagagacagaagccacagaaaaaaagactaacctatttgactgtataaaaccatcataagcatcacaaaaaacaccataaacaaatagaaaaaaagcaaatgatgaattggggaaaatatttgctatatatgtaatggctgatgaaaggttaataaccattccaaataaagagctgtggcaaatcaataagggaaaaataagatgaacaccctattaggagtaaggacatgaccagacaaccaaaaaaaaaaaaaaaaaaaagcatgaatggccaatgaatagtaaaagtaatcacaagatgcaaatttcaacaatgtgataatgtgtttttcttacctgtcatgttgggaaataattaaaacataataatactcacctagggttagcttaagtagagggagcataaaataggacaaccttttggaaggagaattagcagagagggtcataaactttaaaaatgcacgccccctttgccccagcaactcccttttcaggaatccaaggaagcagtcagggatgtttatagaaaaaaacgagaaacaaccggaatgtccaacaatcggcacttggtcaaatcaatcaaagttcatgctgatgtgaggacagtcttgtccatcatgaaagatcatgtgttcaaacaatttttagtaagcttcaaaaacactactgttaattgaataaagcaggaacaaaaccaatatatagcatgattctaatttggttacagaaatactaatagctaacacttcgtgagcacttactttgtgccaaacgctgtgctaagcctgcagaatcgagctcaccccagccctgaacaacctgtttgcttcctgaatatggactctggtcacacacatgcagtcctggggtaggtccacacagctaaactacggttgacaatggtgtgaagtgctccctgcccccccgccccaagggtctcctctaaagcgatacaagcaaagttcagttaagtgctcagcttgccccggcaccttgcaatcctcctgctactagggtgaacagaactgatgctcactctcataaaatgtaaaggtcctcggcgacattactattattaaacgccagctgtgtacaaagctctaggctggatgctggctgggaaggcaggtgggggaaggcaagaaaagagagcgggagagatggaggaaaggagatcgatggagtgtggtcaagatggaggagacagagataggggagatggtcagaggccaggagagatgcggggaaagagagtctgagtgtagcgacagacagatggcgggagaaagagaggcagagaaacatgtaaaagagcaagacagggtgagcagagagacagagaaggatgagaggcatcaagagctaagagacaaagagatgagagagatgcagttgaaattttcagttgcacctggacagcatttcaagttgttcaaagctctgaaatccataaagactggcagctgacatattttaaaaatcctatccatctacgtatcaattgatgaattcatttatttttgcccctgcccatgcattaagtacttcacctttaagtcttctgccatttattctattattatttttttaaagaccttacctggctggaatcacggtagctgggtacatcccactgtaccagagggcccctgacccccccgccgtgcctacctccctgccatctcctccaatggggcccacatctggtaggggagagcagggacactcaccttggtgaagtggactgacagaaaaggatcagcctggcttgtgggaaactgtcacgtatcaaaaacaactttgcttttataccgagaagaaaaaccacgctgtacggtgtggaagccgcagacctctctcttctaataatccaaatttttttcgatgagtgtgtgc

SEQ ID NO: 2330 - DNA, 14393 bp, Homo sapiens; identical to SEQ ID NO: 2329

SEQ ID NO: 2331 - DNA, 28312 bp, Homo sapiens
atgtggtccatgcctgcctcctgctggggaggggagggcaggaggtttattgagcagttggggaggggtgggaattcagagggcgtggacgcaggccatctcgtctcccaagtcctcctcatcgaagcgggagaggatggactcctcgtcgctatagagagagctggttccctgtgccagcaggtcactggcagcattgtccatctcatccagcgtcaggcgacacgcatctgcaatctcctgcttggccagggccacgaaacgtgggtctcgagcaaagaggcccagaccctctgagataagcacctgggggcacaggtgggatcagtgttgacggacggcacagtgtgcacagaaggttcagtgtggataaatgacgtgcccatgagggcatgtagggaagtcagtgggggacaggggtgagcagaggtcgtagggcaaagggatatctacatgcacaacacaggacctggggactcctttccgtcctcctccagtacccacctcctccccttctcccccatccgtcttgtctatatgccctctggactcacagcctccaccaagctgtcggcactgcccctcttcccatggctggggtccgagtgggttccaggcacgtgcagacaggtgaaggtgcgcagtgggccactggatctgccgaggtacccctcccccgctgcgccctcttccaccaacaacagcggggcatacaggagccgaccccgctgaggtggtgttgcccaggaaccctgagccagaataaacatcagaggggcagggatggatgagtagggtatgagggtctaggactcaccgctgtgcctacttctttccctcagtatacaactggagtgaaattgaatgggtataagtcaggcttgagtttatttatgtaagagtgcaggaggcctgggtttaaatgtcagctctgccacttactagctgcatgatctggggtaaacctctcaggacctcagtttcctcacaagtacagtgagcattgtgtgcattcattcatatgtgtcctgttcttcagaaggctctgaggccaggcgcggtggcttatgcctgtaatcccagcactttgggaggctgagacaggcggatcacctgaggtcaggggtttgagaccagcccggccaacatggtgaaaccccatctctactaaaaatgcaaaaattagccaggcatggtggtgagcacctgtaatcccagctacttgggaggctgaggcaggagaattgcttggacccgggaggcaggggttacagtgagccaagatctcaacactgtactccagcctgggcagcagagcaaaactctgtctcaaaaaaaaaaaaaaaaaaaaaaaaaaaagggcctgatatgtgctgtgtttgagaaattcagcctaggctgcccccatctctccagaccccagaccccagcaccacctccacagcctcacctgagccctattgggccctgaatttcgcccacgatgataggtgcctgggatgggtaaatcctcacaactgccctggcgctgcagacactggatggtgaaggagggcttccgacctgggggtgggtggggcaccaggggcaaatagcaatgtcagtgcttccccagatctctgtcctgcaggcccgtgggggccccttggatccatccctgctctcacctgcaggtgtggggggcagcagacggcggcgtggtaccaggtgcccatccatgtatctctgagctctgtgaggtggcaaaaggactgagcacgggggagtccctgcctgctcatctaggtaggaaagcctgtgtgggtgggagggccaggggtgaacttgggtctgggcctggacctgggcctgggagatggggcacaaacagtcctccccgacccagttcccacccctcctccaccccagctcatgggttcatcccatgtggcatggccagtgtaccgatcagggacttcctcatcctcatcttgcttgttttgccctttggttcccttgggctgagaatttccttcttctgggatggtgaaaatgagagccccagagcctctcctggggaaagggaggcacgttaggcagaccagatccctcaatatgtggccctggacccctggttcctctcatcccatgccccaacccttacagaaacactgggcttttggatttttttgttgaggacaagtcacataaaattaaccattaaccattttaaagtgaccatgggcttttgtttaatagatgttcatctaattaggactgaaagtttcaaaaaaatcaaagttgacctgtagagagacaccttgaacacaaaactgggcatgtattaggagtggggggagcctgtaaaagctaggcactttatttttttatttctattttttattttctgagacgaggtcttactctgtcacttaggctggagtgcagcagcatgatctcagctcactgcagcctcaacctcccaggctcaatttatcctcccacctcagcctcccaagtagctgggactacaggcatgcgccaccatgctcggctatttttttattttttgtatggacggggtctcattatgttgtgcaggctggtcttgtactcctgggctcaagcgatcctcccaccttggcctcccaaagtgctgggattacgagtgtgagccaccgtgcctaggcaagctagacactctgaaatttttttttaaaatttttctttaatctgcttatgtattgtctagcagctaagtgtttgacatgcattacctcatttcatcctttctttatccctgtgaagtaagtgctttgtcatcccccttaaacaggtgaggaaactgaggctcatagaaacgaagtgactaggcagggcacggtggctcaagcttgtaatcccagcactttgggaggctgaggtgggcagatcacctgaggtcaggagttcgaaaccagcctggccaacatggcaaaacctcgtctctactgaaaaaaaaaaaaaaaattagcctggcattatggcgcacgcctgtaatcccagctactcgggaggctcaggcaggagaatcgcttgaacccgggaggcagaggttgcagtgagccgaaattgtgccactgcactccagcctgggagacagagcgggactctgtctcaaaaaaaaaaaaaaaaaaaagtgattagctcaaggtcacttagcaaatggcagaggcagaatgtgaactgaaactcttggtttcacacaatgtgctttttgcattaaacctttgtattgcctttctcatatgaatctcttatcaccctctattcttacctgagcccttgaaacacctccattcttcccaaatttctgcttgaaggcctctaggccctccctcccacccccctcaacttcctgcctcctgaattgcctctatccagtgtctagtccttgccttccctcacaatctacttccagacacttgataatacctgtgggtgttggatccagcctggggcacactgggctgactggaggtgggagtccccctgtcatcatcactgggcccaaaggagagtgaatctggaagtctgtccccgacaggcagagacacagaaatcccggagccccggcgagctgagggctgggagaccatcgtggcctgtggagagtcacaggactgagtgttgcatgcactttgtggctaagtcatttggtcatataacatgtctcccccacaggtccatgaatgtgggccttgccctccaacagcaatggtaaatgtcaaataaataaatacgtaaataaataaataaatatttgcgatagggtcttgtcctgtcaccaggcgggagtgcagtggcatgatcacagctcactgtggcctcatcctcccaggttcaagcaatcctcctgcctcagcctcccaagtagctgggactacaggcttgcaccaccactcctagctaatttttaaatttttttgtagagaggcggtttcactattttgccaggactggtcttgaaccctagggttcaagcgatccttccaccctggactcccaaagtgctgggattataggcatgagccaccactcccagcctcaaataaatatttttctattgcagagggggcttctctgggggagcttcttcccagaagcagtgtcaaaatcactcaggggattgacgaagtattttacaatcaagttcctgggagagtgaaaacttgtccccactttgttagtttccaagtccttttcatcttcctcctccactccctcctgcccctcttcttcctcctcctctgtgtcacaggtgagggcctgccgcatctcaggacccaagtcctgcaggctccgcagaccagcctgtgggggtggagaaataggtaagcaggcagctcagggtctgaactttccctctgtttcccctgcaggcgggtagggtgggggaaggagtccttcagccaccctggccctccgtgaggcctggggcctcagtttccttatctgtgacatgggtttcacaagatcaaaatgggggtcagcctcagccacagcactgccacacgtgcccatccacactaggccctgccccgaagacctgaagggcggaagaggtgctaggggcggcgtcgttgcctagtagccctttttctttcctccgccggaatttgcggaaatagtcctggatcagaaatgtggcgtagaatttgcccacggtgacctcctcctctaggggcaagggagagaaggcaagatcacacaggggccctctgacccagcccacctcgccgcctctctacccaccagcatggacttcccctcgccctctgcccagcgctggttttgtggtggagagcgatcatctgccattcaggggctggcgcggggaactggggcggggatagctcaccgtctggtggggggatgacctcatctagcagcttctgtttcatccgcttccagatctttttgatgacaatccgcagctcctggttggcttgctccaggttccctgcgttggaggaggatgtggggcatgagccaataggaagaacctccacagctgccccctcactgttgggtggggggaacttcacaagctgctaccgcagatgcacaccgcccccattggacggggtggggggaaacaggcctggagaatcctgtcacccattctggggttcagagctaggagtggggcccatgattcaatgagtttgctccttgcaccctccccaggaacgatcccactcctgcccctcccctacaccttctgttttgatcttcagggatgtccggaccagggcaaagagtgtggcgttgaatgtcaccgtcccatctgagttgaggggcatgttcattgccacaagtctctgcaaacacgagagacatgaaacccactctgggaaaatgccgggtatgcaggaacgaatgtcaaggggcagaaacctctgaggatgcgatcaaacacccctccccacccaaggcagatcccttcccacccttgccatgtgatagacagttctctcaggagcctgggggtgggcaggtgcacagaccttgcaggccactcggtgtgggcacagcttcccaaatcccagagggggctggatacgtctcagcagggcaaccacatccaagtgtttgatgcggcccctggaggagttggggaggtaccactggattggcgatgcccccactagccctttctcaaggccccaccagctcatcactacctcctcctaccaataccccagagcttgccagggaagaactggagggcagtcagagagggcagaggatggggcagtggaaactttggggcatctattgactgggtaatgagatgcagcagtcggaggtttgggggctaggggactgtgtagggcaatacattgtcccctggattctaggtaagggtatagagggcatacttggccccagggtcatattcagaccagatcctcttgaattcatcaaggtgatgggggcccaggatggaccaatctctggtgagataatcaaagttgtccatgatcacagccacaaagagatttatgatctgtgggccagtgagcaagggagcagttaggtgaagggcagaacactgtcatggacggatggtgggaggctggggcgggcttatatggtcatgagtctctgggttgatcttgtcatcagaccagccctctcacccactatgaagatctgggctgcccacgtcacatccctgagcccctcagggccagcccccgtgacggtggtggtggttgtgaggaaatggttctcaccaggaaggcacagagcatgaagaagctgatgaaataggcgatggcaaaattgctaccacaggtaaactcttcaccagggccgaagtcagactcaggatcacaccgatttccgggaaggctggcaagcattatctcctgccatgcctcaccagtggcacacctggtgggagtcacacaggggtagcatcctgaaggggaggctatgaagtcatggtaaatggagttgggggaggactggggaatgaggagatgacctacttctcaccaggggctacatctggcacagataacatttcaatattttaacagccagtgtggccatgttgacgacagtcatgtttgcatcttacagatgaggcactgagacctgagaaggggaggcgtcttacagtcagaaagaaaatggctgaggctagaatactctaacagactcctcacatcatagccaggaaacatctcgggctgtatggagccccatgctgccatattattcccatagctcaagcagtctggggctcagagagggtgggtgggcacccacgggcataaggtggcaggggagtgagtagatgtcacctgaacagaagcagcacagcctgtggaaaggtctggaagttgttgtttcggtttatctgtgtgccatcctgaagagccaccttgccgaacatctgtggacacatcaaggctgtgtcagtggggtgaacccatgccccacccatttcacacctcctaatacctaaaggagcctcataaccctgacaaacagggcatcactgctgatctcatttcacagatgtgtagattgacccagggccgtccagcttgtctgtctacctgccacccctactttggggctattcttaacccatcccctgccagcagaggagtgcttaagggatgcttcctagggtccccacttgcctgcatgccaatgacggcatagatgaagaatatcattgcgatgagaagagccacatagggcaaggcctatagggatgggggaggggggcagagaatagatgcacaggctcaggcaaagaactataagccccagaatgcactgctttccctggcctgggcctactgggagatgcagtccatctccaaagtgccaaggactgtggtgtctctcaaatgtgaacatagtgttaagtagatagagtaaggtcagtgagaccagaggtgtgttggaaactgagagcccagaaaaaagagaaaattggaataataatttggaaatgggtatggcatgttgggagatgtagttctgagggtggtaaaggggcaggctgagaagtgtgaaatgggggcgaggtatggtcaaagggatggggtaggggattacctggaaggacttgatgaatgtccagagcaatgtgcggatcccttcacccttactgagaagcttgaccagccgcataactcggaagaggcgaaagaaggtaatggaaatgcgggagctgtcctcagagctctggggtgaggggtgcagtagggatgctcagtttgcatttactccagctatctccctatctcatgctttggccctcccagtacccaaatcactcaggccctagggtaatccggagggatggagggacagagggacatgggaaaagaagcagagagtccctgttattagggtgggctacctcgccaaggtggccaccattctggagggagatatggccaagaaaaaggtgatacaggagatgatgacatcataggcccaaatgaacaaggtgagatatgatggagcagatatagggggtgatggtggggtcattacacaggggacaatgggaaagtttatatggtagtggattaggattaggaaaaagtgggtaatgggaatggaagggagaggagagagtaaaggaggtgatggatcagagacattggagccaatagaggaaatgatggaaccagtggtgtcatagagatgatggagatgagagaaccgatggagaagccaatggagaagccagtgatggagatagggaaccagcagcgttgtcagttgaggtgacagaaccatgtagtacccaatggaggtgatggagccaatgatatagtcaatggtgatgacagagccatgaaagagccagtgtcagagatgatgaagttggtggagaaatgaagccaatgaagtcatcagaaaagatggagccaaagcaggagccagtgaacatgacggagccaatggatgggggatgtagaggcaatgaaagagataacagaaataacaggagaggcatttcaggagatggtggagccagtagataggttacaaaatggaatgagaaagccagtagagggggacttttgctgaacccaacagggactcagaagagatagagctagaatgaggactgagtctccaggagtagggaggatgtgcgtgggagccacccacccacgtgaaagggaaccccgggatagaggtgagggaaggtgtatagggcgagagtggattagtggaaaggccagttctcacattgacttcagtgacggcaatatccactatgctgcccaccacaataagagcgtcaaacgtgttccaggcatcagtgaagtaatgctgcaagtaggagaaaagcagtgccctgtcttctcaaagctcgcaagccagggtagggggccagtagtagtagggggcgccggaggggggcagggcttcgcttggatcacacgatgggcctgcacctgagtccctctcactccctagactcacactccctggctgctgcccgcatcgccaaccccagagctctgcaatgagctccactcccaaggaattcatccactggtgggtggggctagagaaggggggccaccttgggcttgaaggcgatgattttgagcaccatctcaatagtgaagaggccagtgaagaccatgttgaggatgtccatggcatagttgaagggagcagtctgctcatagtgctgcaggagaaaatcaggttgagatggagcctgaggcagagatgccgccacacccaaccaaatattccctggcctgggctgaggcgagtctggggacttgattgcactgtgtattggtcaaacctcttgcactgtctgcctcccattatggatactggaaagtttagttcttgattactagcttttcttgtagttaggcaaggccaggttgactagtgagacataaacataaatctgctgttggttagcagcttgtgtaaaaaaaattttgctttccgatgaaaggatcaaataaggagaggccccaggtgcagctctccctgccttgagtgtggttttgatgcctggagctgtgatcatgaaacaacaatcatgaaaatgaatgccaacttgctaagaatggtgaagcagaaagatagagcatgggtcccggatgaacaatgaacaaacagcctacctctgcacttctcaatacatgaggtaattaccacagttcattgactccaggaggcacatctttttacattttagaatctctgaaattggggcgcattttataacaaatggcaacttacaatggccactggctacttttttttttttttccacattcttacatctccgaaatcagaatgcaacttacaagtactggccatagacttaaagaaatgtggcaaatgtctttatagcttaagttgctgttagttggcagggggtttgttatttgcagccttaaatgttcccaatggttcccaagggattatgtggagataatagggtcaggagtctggcgggggtcaggcagggatctcagacctgcatggctagggcaactgtgttgagcaggatgagcaggaacatcaggtactcaaaggcagcagagttcacagtggcccacacacgatactgatgcgggttcttggggatgtaacggcggagtggctgggccttgagggcatattccacacattgacgctgcataccagggcagggcatgagtgagcagtggggtcctgaggcaaggagggaagggttggtgaccatccatagggggtcaggggtcagaggtcacctggttcttgtccagctcacagttttggtactcctgctcgccctgggcacggaaagtgatgatgacgaagcccacgaagatgttcatcatgaagaacgcaatgatgatgatgtagacaatgaagaacactgagatctccacacggtaattatagatggggccatggtcctctgcatatgcatcgatggccttgtatagcagtctgtgggagccagagggggggtagaggtgggggcaggtgaggggatatcccagccccctcagacctgcccccagtctacttatcacagacaccccagagtttcctgcctggcaccccaaagacccctaaatctcctgacctaaccacctgggacctccatacatactctaagagacctctaccaggccctcaaagagtccaaatcctctgtcccatgccctcagaaacccccatagagtcctccagagaatctccattcagaacctcaaagacccagaaatcccctaagtttccacagaccttcaaatccccttctccaaccacttggagacccccatgcgcctccccagaacttccacacaagcccccaacgatctgtaaatttatccctgtcccatcaacttgaatccccactccatctccccacagagccccacaatgagtatcccaaagacctgcacagctttctagaaatcgctgaatccctgcttcatctcttcagagaccaatcccagtcccctcagacctccactctgtccccccaaaccatctccaatcctttccaggcttctatctagctacctagtcccttagaaaccgctgtccaattcctggagacccctcactcaagtccccaaagaacccccacccagcttctgggaactccacctctacagtcctctgatacacccaccactctccagaaaaccctatccagtctcgagagaccttcgtcacatccccaaggtacactcccacccattcccaggagatcccaacccaatcctgcagagacccctgcctcatcccctgataaacccagggccctgtccctcacgcaggccagccttcaaaggtggagacagtgaacagggccatcatggctgaaaggacattgtcaaagttgaaatcactgttgacccagagccgctcccggaccaggggccgtgacacgtctccatctgggtataccaggaaggagcccctgtggatgtgcaaacaggttagatgggtgaggaggggtgaggaactggggaaagggtctggggtctccagcatggaggcagcaggacatagtggtggagcaatatgttctaggttcaaatcctgtccctccatgtcctggctgggtgaccttgcgcatttaccctttctgtgcttctgtttccccattctaagaaataaggataataacagaatcgatttcctggcttgtcacaaggattaataaatgtcacaagtcaataaatgagactagtgtctggcacatagttggcatcatttcatcatcaccattatcatcctcatcatcgcccaccaggaaaaagtaaaacgaataatagccaacgtttattagcagtaactatatgccaggcactgagctagattttctttttcttctcttcttttctattctctctttttttttgagacggagtcttgaaaaagactctgcccaggctggagtgcagtggcatgatcttggctcactgcaacctccgcctcccgggttcaagcgattctccctcctcatcttccagagtagctgggattacaggtgcacaacaccaagcccagctaatttttgtatttttagtggagacggggtttcaccatgctgactaggctggtgtcgaactcccaacctcaggtgatctgcctgccttggcctcccaaagtgctgggattacaggcgtgagccacagcgcccggcccaagctaggttttctgtgtagcaactttacattgtacaaagtacattttccatgtagtagctcatttactcttcacaacagccttgtgagataggcactgtttagccccgtttttcagttgagtgaaatggaactgagtaagtttaagaaatgtacctaagtctcatgaagtggatttgaaccgtaatgtctgacttcacagcccaggcttttagctactaccctctacaggagtctcaagatggaagctgggggctcagggtgggaatggtgattgctaatgggtctggagtggaatgtaggtcacttggggaatgcggagagggatttgggggaggtatcgggggccgccgaagacttggtgagatctgagggcctctgcagttcttgggacaattctgggactatatctttgggccttggtgagatctagaggctctaaagtctttgggaggggtcctgagctccgtggacggcagggtcttgggcactcacttgcattcttgaggggtgtgtttggcctcgtccgtgcaggtgtagaatttcccctgtagagaggatgtctgtcaagtaggttcacccttcatcacactcccgcccagacccctgcctggcattccctccagtgtttgccccaccttgaagagctgcaccccgatgcaggcgaacataaattgcagaagtgtggtgacaatcatgatgtttccgatggtccggatggccacaaatacacactgcaccacatgctgcgggcacccaagcatatggctactgaacactacaggccacagtggtcatggggcagggactctggtcatagatgcagctgagggacttgggctggggacatgtggtgatgggtcagggatgtatggttagcaacatgtgttcaagaggcagtgttatgggctagagacgtgtgggcatccaccaggaataagtgtttgccgggtggggatctgtggccacctgtcagggagctgggtctgagaaatgtggccactggtagaaacatatggtcacttggaaggaacatgggtcaggccacatggctagtggtcagagatgtgtatttatgtgtcgggtccaggccgtatggtcatgcatccgtgcaaatggtcagtttgatcagtgatcctggccccaggggcagggcagggcctgggtcctgtgggtttgggtggggtggggttaccttgagtcccttggccctgttgatggctcggaggggccgcagtactcggagtactcgcagaatcttcaccaccgagatggcgctggagctggggaaggggcaatcctcaggcattggccctggctgggccctggctgtgagaggaatggggtgggctggggatctgtcacttactggatgccaaaggagatgagggacacactgaccaccagcagatccaacatattaaaccagctacggcagaaggagccgcggtgcaggaaggccccaaacactgtcatctggggacaggacaagaggctagactcagacctggggatggtgggggttgggggaggtggggatggggacaggagaggtgggctgcaagaaccggtggggagagtgccagggcaactgagggtaggactggggtcccattagtcacctttagtagaatctccacagtgaaaatggaggtgaaggcataatcgaagtaacccagaatctggggtgtgagaaagagcggggagccactgagtcacggctgagggggatcctaggtgacttctcaaaaggcttggccatcagaaagattagggttcaaatttggacccttctgcctctacccagctacatgggcgcctttggcctgcttaacctctctgagcacagcttcctcctcagtcaaatattgatctcctccctggtgcttccccgtgtgttgcacatgccgtaaaggctggcattgcatcagctgcgttaatgagcccctctctcggctcacctagggctcttctccttatctccaccctgacccagcttgtgcccactaggacacccctgggagtgtcccctcagctcctagctcccagccaaaggctcacatggttgcggaaggagtgggctcggatggggtcctcagcggccagggacacactgctgaggatgatgaacaccaggataagattggtgaagacatgatggtggatgagggtgtggcagcccttcctcagcctgtggagagggagtgggccatggtcagaactcaggaccacagaattgttcagggattccaagggatacagttctggccctgacacaacacccatgcccccactcccaccttggctgctcctccatgctcctccacctgccctagcccctcctgcctcaccccctgccacttccggcactcacgggttggtttggctgaggcagaagaaggcgctgccctcagggatgggtaccaccttctccttgggtacaacttcctgcaggagttccacaccccctgcaccctcttcctcttcttcctcttcttcctcttcttcctcctcctcctcctcctccatgtctggcaccagagaaaagcaaaaaaaaattaattgagcaagttgatgtaaagcacccagaacagtgtttgccacgtggtcaattcttcccatttccctgctagaatgtcagctcctccaggaaggtattttagtctgttttgtatgctgctatgtccacagcacttagaacagtgcctgggacacagtaggagctcagtaaatgtgtgttgaaagaatgttgtatatacagactattttataataaaggctctgagaagttcagcagtaaacaaaacgtgtttctcttcttcttgtttttctttaaagatagggtcttactctgctcccccaggctggacttcagtggtgccatcatggctcactgcaaccttgaacttctgggctcaagcaatcctcctaccttagcctcctgagtagctgggactacaggcttgcatcatcatgcttggctaattaatttcttttttagagatggggtcttgctatgttgcccaggctgcatttcccttctttaacctcaatgttcccaaatgttgctgaccacataccaagtctgttattttcaggatgatcttggaaaaggctgatctctggagaggagggtctcaggggtcaggagctgtctgcctgagctctttccccaaggtcccacacctgctccacctggccctgcccacttgcctgctccttccctccttgcaccctcctcttcctctttctccacaccaggcacctgaggacaggaagacgggagtcatcaatggtgagggagacacagggaatggacacaggggaggcatggaagaaatgtaataataggggaaagaataggcagaggatgaaggttaaagacatgcacatatggctgggcgcagtggctcatgcctgtaatcccagcactttgggaggctgaggcaggtggatcacttgaggtcaggagttcgagaccagcctggccaacatggtgaaaccctgtctctttcaaaaataacaaaaattagccgagtgtggtggcgcatgcctgtaaatcccagctacttgggaggctgaggcaggagaatctcttggacccaggaggcagaggttgcagtgagccgagatggcacaactgcactccagcctgggcgacagagtgagactctatctcaaaataaaacaacaacaacaaaaaaacagatatgcacacatagacaggtagtggtgggagtgggaggtgtagacagtgcccaggcatctaactcaccaggccttcattctcctgtgggagatccttctcattgctcttctccctgtgcgaggaaataggggtgattgctgcagatgggctaagggggatcactacagtcagaacagacctttcttgggtcccatagaactttcttgcttccgctcttccccactgcccctcccaacagtccgttctcaaagcagccagagggagcctgttaaaccctgtctgggatatcccaactctgcccacaaccctcccatgtctccttaattcaggaaaaactacagtcctcaccctggcccagaatgccctcaatctggccctccatttcctccactgaccttcactccataccactctcctccttcctcactccattccagcctcactgtttttatttttttgagacggagtctcactctattgctcaggctagagggcagtggtgcgatattggctcactgcaacctccgcctcctgggttcaagcgagcttgtccagctaattttcttttgtatttttagtagagacagggtttcaccatattggccaggctggcctcgaactcctaagctcaggtgatccaccctcctcggcctcccaaagtgctgggattacaggcgtgagccactgctcccgggcatcgctggtattttttgaaagtgctaagaatgtggtcaggtgcggtggctcacgcctgtaatctcagcactttgggaggctgaggcgggtggatcacctgaggttaggagttcaagaccagccttgccaacatggtgaaaccccatctctactaaaaatacaaaaaaatttagctgagcatggtggtgtacgtctgtaatcccagctactcaggaggttgaggcaggagaattgcttgaacctgggtggcggaggttgcagtgagctgagatagcaccactgcactccagcctggatgacaagagtgaaactccatatcagaataaaaaaaaaaagtgctaagaacattagcgccccagaagctttgcacttgccactccccttccttgaatactcttcccccagatatttgcatggctcactccctcacttcattcaggtctctggtgaaatgtcacttcctcacagagaccttccttgctgaccttaaccccaaagagcaatcttcatttcttgctatcctttcattctgttttctctttattacatattattaacatatattatatattcatttgttttatttttcttgccttcctcaactagaatgttagttccatgaaggcaaggactcttgtctgccttgacccctgttgtctcctcagcatctagaacaggacctggcacacagtaggcagtcaatagatgcatgttgaatgaatgaggactggcagatggtatctggagatggggattaccagggtgactagaggcatctctggtggtgggggtgtctgaggggttcccagtcagggatcccagagagagactgtgttaggggtggagccagatctcacccgcccttgtccttggcagtgcctgcatctccactggccaggttgtccacagcaatggcaagaaacacgttcaacaggatgtctgggatgagcttaggctgcaaaggatggagaagcaccctgcctatagaccacccagttccccttacccaccccgactccaccatcatccagccccacaaagctccaaggatacagttgccacagatgaagagaatgatgaaatagatgcacaccaacattcctgggaagaaggggccaccatatgccatgataccatcatacatgaccacgttccagtcctcacctgtcaggatctgggggtgggaagtcactgtggagctcttggaccccctccaactccagggtctccccgacccacccatcccatggtctccagatcctacctgaaagacagtgaggagggcctgggggaacgtgtcaaaggtgcttcgcttggtgtgggtctggtcaaagttgaacttgcccccaaacagctgcatgccaagcagggagaagataatgatgaagaggaagaggagaagcagcaaggatgcgatggatttcattgaattgagcagggatgccaccagattgctcagagaagcccagtgtctgcagcagaaatgggagggggcagggtcgatgccatgtccactggacatggctggagcatcaggagccagggcagggctccagcttgagatgcacctcggcaggttgggctcaaataggctttggtgtcagggttagaaatgattttggagttggggtgagatgagagtaagaagtgggggaagctgggccctgtggtggctcacgcctgtaatcccagcactttgggaggccaaggcgtgtgggtcatgaggtcaggagactgagaccatcctggctaacacggtgaaaccccgtctctactaaaaaaaaattagccaggcatggtggcaggtgcctgtagtcccagctactcaggaggctgaggcagaagaatggcgtgaacccaggaggcggagcttgcagtgagccaggattgcactgcactccagcctgggcgatagacagagactctgtctcaaaaaaaaaaaaaaaaaaaaaaaaaaaaagaagaagaagtaaagaggtaggggaaagttgagagtttggggttagggttggtggtaggggtataatgggagactgggagatgaggttaggatggagtttttttttttcttatcttttttttttttttgagatgaagtctcactgtgttgcccaagctggagtgcagtggcacaatctcgtctcactgcaacctccaccttccaggttcaagcgattctcctgcctcagcctcccgagtagctgggactacagtcacttgccaccactcccggctaatttttttgtatttttagtagagacggggtttcactacattggccaggctggtcttgaactcctgaccttgtgatccacccgcctcagcctcccaaagtgctgggattacaggcgtgagccaccgcgtccagcctaggatggaggtttaatggaagttggtgaagctagaattgggtttcagcttgggactgggcctggtgttggggatggggttgtgatgtatttggggttggagatggagttaagggtaagttgtggttgagggctgggatagaggaggggatgggatgagactggggctgaggctggaaatggagttgcagttgaagatagggtgatggttaagggttagggacgtgggagttctctttggggattgaggatggtattatggttggtggttagtgacagggatggggctgggagttagggatgaggtgggagatggagttgggcttgggaatgggtgttagcgttgtaaatgggctcataggtgacctgtggttgggggttgggatcagagatggtattgtggttgggggttgggatggggtttgggctgggaatagtatggcattgaaatcggagacagggttggggaaaaacgttagagcaggagttgaggttgaggaaggcaatggaaatggagtagacattctccccagtggatgaagacaggaacttgtgtctgctttgattcctggtgtttccctagggcttggtagggtgcctggcacacagcaggcactcaatggatgtctgctcaatgaatggtgaagcagatgaagttatcattggagcttgggtgggggtgttgaggctgtgtttgaggcccttgtcttccccctcccctaatacaaacctggtgaccttaaagatcctgaggaggcgcacacatcggagcactgagatgcccaagggctgcatggcgcccacctccaccaaggtggtctctaggatgcccccacagaccacaaagcagtcaaagcggttgaagaaggaagacacataggcagaggggcccagaccgtacaatttgagaagcatctccaccgtgaacagacagagcaacactttgttggcatactctgtggggagagaggcagggatgatcgggctggccagtttctgtggtgacatgtggggaggtaactagggaccatggggtgacccacggtagctggtatcaggccaggtgctggctgagggaaggcttagggctagggattggggtgagtttgtaggtcagagtaggtgaagttttgaggggcttggagatggggatgaggggcagagtcggggtgggggccagagtcagtgtctatgagtccagaagacccaaattcacaagtagagttagagtctagggtttcttcgggactggggctggtttgtgggttatgggttagaaatgtgctcggtattcaggctggggctgagattataatgaataatagtaagagctgacacttataaagtgttagctatatggtgggccatacaatgtcctaagcacttttcactttacatcatttactcctcttcgctgcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaataggaggctgggggagacgactagcaggctgggggtgtaccctggatctgggtgagccacacaggctgcccgtggtgctcagaggcgatggtcaacgtgttgaggaagacgagcaacagcacagcccagtagcaggcattggacttcactgcccgacggcagcgtgcccgaaggacccggttggctcggcggaggcggcggctgggggaaggggagcccacaggctgagatcacctacctaagcctgccctggggggctcaggtgggggatccaaaggtcatgagggcttggaggtggggggtttcaaagttatggagtcaaggatttgcacaactttcccaactcaccagactctggttttcatgatcttgtttctgaaaaagaagggggatgggaggtgtgtgtcgtaaagggcagaaggggtgtcagtgactggggccagaggtcaaggactgagatcgaggcttgaggctaaagaaaggacttgagtcagggtttggactggcttctgggctgggtcaggggctgggggccctcacaggcagcgtgtacagctggccagagccccctcctcctcatcctcatcgccttgggtctctgtcatggaaccggtgtcactggctgggaggctggctgtaggcaaggtggggatagtggtcaggacctgaagaccccgaggtccaatctttggctttcacctctgcctacccacccccaccccagcctggctggacccccaccatggctgctggtggagtgtgtggagcgagtagaatgactgaaccagcgcagacgtccacgcctcctattggtcagctcggccagctgtggccctgcagggagagaaaggacaattagggaggacatactgggggcagggttagggccatgtctagggtaggggtgtcatttggagtctttatagctgaggctggtcttgattctgcattttgagccataacttgggggctggggctagagttgttgcagatcaggcctgggtgggtctcaggagggcagaccacatctaaggcatgcagggaatgggccagattggagttgcctacgatggcccgcccggccctcttcagccatagaaccaaggttgtcatcggcggaggggtcctccatgtccagctcttcggcttgagtgatccagtccaggtagccccgcaggtcttcctccatctgctgcttctcccgctgcttctggaagtccccgcgagctttcgctttctctctctccttggagaactccctgagggaggaggatagagggctagggggaggagccaatctgaacaccttgctttcatcactccagccacactagcctcctagctactctttgaatatgccaagcacattctagcctcagggcctttgcactgaccattctctttgcttggaatgcttttccctcagataaccacatggtgcacccacctcatctctttttttttcttttccccagatacagggtctcactctatcactcagggtggagtgcagtggtgtgatcatagctcaccgcagcctcgacctcctgggctcaagcgatccttccacctcagcttcctgagtagctaggactacaggtgtgcgccaccatgcccagctatttttgttcattttttgtaaagatgaagtctcactatgttgcccaggctggtctcgaactcctgacctcaagccatcctcctgccttggcctcccatagtgctgggattacaggcatgagccactgcacctggcctctttcacatttttactcaaataacaccttgtcaagacagcctttcctgacatccctatttataatcacaagatctctccattcttatcttttatctttcctttctttccacagtacatattccatataaaacactatatatatgtgtgtgccaatatataaatgcacacacttattttattgcatatgttgctactttctgtctctccccatcagaatgtaaaaccaggaaggcagagatttttgtcttttgttccactcctaaaatggtgcctcacatacaatagatgctcatgattgaatgaaggagtatttcagatgggttttgaaggatgtctaggagtttgccaggcacaaagaagtgggcagtggctgaggggtgggaagcagggagtgtctaggtccctcacccactcaggacgccaagcacaaggttgaggacgaagaaggacccaaagatgacaaggctcacaaagtacacccagggcagttcataccccatggcatcttgcatctggggagagaaaaggcatgcatccctcagggtaggcagacactcctgcgtgagtgtcagggaggaaaggcaggtgcagcctttgagctctgtgcccacagtccacctcacccagtagagcacatcggtccagccttccatggtgacacactggaagactgtcagcatggcgaagaagaagttgtcaaagttggtgatgcctccattgggccctggccagcgcccgcggcactcagtctggttcagcgtgcacgcacgccctgatcccgaagacgcacagggcgatgggtcctcctccgcttccatgtctgcaggaagactggagcttggggcttcgaagcaggcccactctcagtcgctgccaccctgaagccccgcccacttaggaagctcgacttgggtcctagatttttctctttctctctttctttctttctttttttgagacggggtctccctctgtcgcccaggctggagtgcagtggcacgatctcggctcaccacaacttccgcctcccgggttcaagcaattctcctgcctcagcctcctgagtagctgggattaccggcgtgtgccacaacgcccggctaattttttttgtatttttagtagagacgggggtttcaccatattggtcaggttggtctcgaactcctgaccttgtgatccgcccgcctcggcctcccaaagtgctgggattacaggcgtgagccaccgtgcccggccagtcctagatttttctaaggcaacacttagctccacttctagggcagaaccctgcgagctccgtattctgaaccactgggaagctagggatcccaccaaccgggatttaaatcctggcgtggagtcttgtaaataacaatgaggcaagagcctgggggcggagtcttgtgaatttggacgcgtctcttgaaaataggggaggggcaaggcatgggcgggagtctgggtaaatggtctgagtgtatgagaacagtcgtggagaataaagcttttttttggtttgtttttgttttgtttttgagaccgagtctcactctgtcgcccaggctggagcgcagtgagtggtgcgatccgatctcagctcactgcaacctccatctcccaggctcaagtgattctcatgccgcagcctcccgagtagctgggattacagacatgcaccaccacgcccggctcaactttgtatttttagtagagatggggtttcactatgttggccaggctggtctcgaactcctgacctcaagtgatccatctgcctcggcctcccaaagtgctgggattacaggcgtgaaccacggcgcccagccgaggataaagttttttaaaattgtttttgttattattttttggagactggatctcactattttgcacaggctggtagcaaactcctgggcgtaagtgatcctcccgcctcggcctcccaaatgccgggaatacaggtgtaagccaaggcgcagagtttttgttttgttttgttttgtttttgagacggagtctcgctctgtcgcccaggctggagtgcagtggcgcatctcggctcactgcaagctccgcctcctgggttcacgccattctcctgcctcagcctcaggttcacgccattctcctgcctcagcctcccgagtagctgggactacaggcgcccgccaccatgcccagctaattttttgtatttttttagtagaggcagggtttcaccgtgttagccaggatggtctcgatctcctgacctcgtgatccgcccgcctcggcctcccaaagtgctgggattacaggcgcagagtcttgtcttaagtgcggggcacttgcacttaagtcttaagtgcggggcaggaccttagcctgtgggtacagtctcgtgatggggcggagctattagcgaggtggggttgtagtctgatttagggcagagtcttgaatatatgggtgggacttggttatctggggatggaacctgagcctgggggccgaatcttgtgcatttcagtgggtttccctgagtgcagcattggatctaggaaccgaaggagggggcatgttctgcctaggaggggcgggcagactaaccggatcccaggaagtagcacgtcttgtgcattcgtccaaggaacagctcgagcccaatgatggcataaatgatgatgacgaagagcacgagcagtgcaatgtgcagcagcggcaccagagccttcatgatggaattgagcactatgtgcaggcctgcggggagggagggggaggcagaaataagggcggggtcagctcagccccacccccaccctccacctccgacctcgggggatgtgccactcactcgggaccccagacaccagcctcagtggccgcagcacccgaaacgccctcaatgccttcacatcgaagcctcctggctttcccccggtgtgcggggcgtcgcctggccgtccggggccctgctccagcagaacgctgaacagcctgatgggggagcaccgggcagggaggcggaggtcaggccttgggattcccccctccaccctaaccttctcagaaaagcacaagtccctgtaactagaaatagaaatgggttttaataatattcctgattctggctgccgaatgggggcggtctgaaagagtcgctttcctgagcccagaattcagcgggcctgacggtaggaaggcgactagggtggggtgcctcccgcagacgcgcacccgaccacgacgatgatgaagtcgagtaggttccagccattgcggatgtaggcgctggggtggagcaccagcccgtaggccacgatcttgagcaccgtctccacagtgaaaatcaccaggaatacgtactccacctgctcctgggggtgggaccggggggcgggtcgggaagtcggggagttatttgaaggcgaggtttgacgggggcgtggggagcatagtcaggaccgagggtggggctgagccaggcagggccatccgggtcagagagggggcggggtctggctggaaggagtgagctctactggggctctatttggctgggaactggctggggcggggcgggccttaccaggttgtggttggcagtgttggagtcgtcctcagggaaggggatgtaaactcccagggccacgcagttggcaaagatggtcagcaggatgaggatgtcgaagggcctcaggtggacacagtcaaggaccctggcagagtggcattggaacccccctactcccttgggaacctcccacccagtgctgacccttgacgcccaaggtgacaggtcctggcattctcgacccctgccctgacaaggccttgactttgtccctcctggaaaccttaaccatccccaactcttgctgtgattcagtccttgactcttgaaccctggtgacctttgcctttctgaacctgccccccaacccagttcttgactcttgaccttgatgatctcagccctcctctgttccagccctgacccaattctttactcctggtaccctgatgacccttacccctgggccctgcccctgccttccaggatgcttccactccacgatgctgatgcaggaccgtcgcagaggattggccagggtgaggcagaagagtgcccgaggtgaccgctgggcactggccactgccactgtcttgtgcttgctgtgctggtttcttcgcttaggggtccctaggcctgatgccccactgctttcaccttccacagctgggggcccggggcacagcccccattcgggaccagggcctgccccattggctggactgggctctggggtggtgtctatatggagaaactgtgtcagggagggacagggtattggggcaattgtggctgcttcctacctgatcctgtccctctgtttgaaggaaggagagaagagcatggaaaattagggagaactgggagtagctgggttaaggactgggaagtaagagtgttcgaattaagattagagtgagagtttataggggagtgaaggtgagattacatttccaagtgaagtagggtttggtgtttaagttgggggtagagtttaaattgccatggggtgggcgaatttaaggttaaatttgagtggtgggttttgggttagggtggggatgggtttagacataggtaggagtggagttttgtctaagggttaggactgggtattttgaattggaattagaattaggatacaggttagggtcgaagttgagttttgagtgggacttgaattttgcattggggttttcagctaaggccactcccagttcccatggtctcgtttcagcctcagagggcggtagattggcctggttaagattcccagctttggatgaaacaagctgcctgagtttaaatcctgactttaccacttggtagctatgtgttgccttgggcaaattatgtaatctctttgagcctcagtttccttatctgtataataaggatgataataacagtacctaaaatatagcggtgttatgaggattaaatgagttcagaatcaaaagaatgcctggcacatagagttattcccattttgcagatgagaaaattgagaagaaaaagttaagtgacttgctgaagtggctgaatggggagtcacactcagtctaactctagagccctcatggcttactaccaccatcaagtatgtcttctctctctttctctcttttgtttttgtttttttttttaaagggtctgtgcactttctggaaagtcagagactgcaatcactaacagtattgacatcccggggttgaggttgaggttaggtcactttaggtctgtatctggggtggggtttagactctaacaggggtttgccttctggctggtagagtttgtgttaggtttcaggtgggcgtttggataggggtcagagccaggattgaggttgggtttcctttgggaactaaggctgtggatgaggctgagaggccatggggggtggtgtctgggtcaggctgagcgttagggctctggtggcagagaggctgtttggggctggctgggatggggaacagggtgatgtggttcttgtcccctagaggctctctgggggtggggtctgggtgggcaatgggtgggtcagaggggctctaccttgctccaagggtctgcagggatggaaggattctctcacctttcccgccttcagattccgacatctttctttcgagattgaagggccatctgcacacaacccccctctcttcccccagctttggag

SEQ ID NO: 2332 - DNA, 4657 bp, Homo sapiens; identical to SEQ ID NO: 2326

SEQ ID NO: 2333 - DNA, 3568 bp, Homo sapiens
tgagtgactggcgcagggcctccgctgggggagggttcggagaggagttgggttcagtgggacaggcctggggggtcagcagctactgccctgtcttgggtggggccaaggggcgcgacttggggcggggatcggagggtgcttcgagtgggaggagccttggggttattctagcatattccttgagggttattgcagtcggcgagggctagattagatgagagtgcggaactggacccccgttctggcggcggtcctttttgaggaggcagggcctggagagtgcttggggggcgggcacgcagcgaaggggcaggcctgaaatgtgagtcacgggggtggagcctatagtcccatgggggcggggcttgagatgtcaggaatgggatgagggttagaggctaattagagggcgtgctatggaaggttcaggagccaaattttggagtagcattctccagggtgggccgaatggtgttgtttgagggatgtgttctgcgtgttattagagggagataggaaggcctggaagattattcacatggctgagcccaggattgtttattaagaaggtggggtcagaacagttaatttgtttgggctgagaacctttaagattacttgaggggatggtgcgtaaatggtgggccagtttgtatatgagctgcaggggcaagacaagtagatgaggctagaatgttaactcagggaacaggtcctaggtagtttccatggcatgtcccccaacagccctctccactgcttttatctcccagctgttagcgtgctggactctgcggacatagaggtcacagacagtcgcctgcctcatgccactattgtggatcaccggccccaggtaccatctcatccttctatcggaggcctcctgcctcagggcaaactatgtacacctgtgtcctttattccagcaccgttggttagagacatgtaacgcacctccccaattgatccagggtaaggcacatagtgctccgaagccatcccaggcctctggtcatttctctgtggagctggttcgcggttacgcaggctttggcctcaccttaggtgggggccgggatgtagctggggacactccgctggccgtgcgcgggctgctgaaggatggcccagcacagcgctgtggtcgtttggaggtgagccctgaagccccttccactggtaggtgctatccctgcctttgttggggtgctctccttttgcctttccaacacgactgcattgcactcctccaggtcggggacgtcgtgctccacatcaacggagagtcaacgcagggcctcacccatgcccaggccgtggagcggatccgagctggaggcccccagctccacctggttattcgtcggcctctggagacccaccctggcaagcctcgaggggtgggagagccccgaaaaggagttggtgggtttcccaagggagagaagtcagagatcagtgaggagaagggagaggttcacagagtggagaagctgagattctgggtgggaagggtttggtggtctctgtggggagggtctgcaagaggtcatggtattctcacaagtaggggcagggaggggtacagggtcccaggataggaataacgtaggggcagggaggggtgtcagtctcgaggataggaatttcagagggtgggttttccaggtactggggggagagaagggaaggggtctaggataaaagcaagtgtttggaaggaagggtcttagttctcagaggcgaaggcagagtggatcttagccgggggaaaatgggatggggatccagagggtagggggtctagttctgaaaaacaaagggtcggtggtttgggagtcaacggaggtgggatgagagaggagagagcaggggctcctagatgagcggggtttgatttcctttggagattgtgggaaatgatttctgaggggcatgttctggatccaggaggggaggggtctcgggaaaggaggtgtcggggttgtgaggggtggtgcccatcccagaacgcctgtcaagggagatttctctcaaggtcagggtctcatctcccgcagcctttgggttctcctgtccatcctcagccaaaggcctggatttcccttccctacttcaccacccaatctaatccgtagtcccgtcatggccagatcgcagcccagatcctggagggccggaggtaacggggtctcgcagcagcagcacttccctagttcagcaccctccatcccggacgacgctcaagaagacccggggcagcccggagcctagtccagaggcggccgccgatggccccacggtttctcctcctgagcgccgcgctgaggatcccaacgaccagatcccgggttccccggggccctggctagtgcccagcgaggaacggctctcgcgggccctaggggtccggggggcagcgcagttcgctcaggagatggcagccggaaggcggagacactgagcctacctctgacagcgcggggctcactagttaccgcccaacctggatccggcgcgtgtggccgctgggcacttggcacctccccaagagcttccacttggtttggtccccccacccgctgctcagtggctctgaccacactcccctcgcagcgtcagtggtacgacccttccagccggctagcctgcgcttctggttctgggagggggaggtaataaaatggttcgatccggtcttgacttgccaggcgctcgaggcggggtggggctgcccgggccactctgtaaaggagcaggtgggtcgatcctgcttgagtaatcgctgacgagcttcgtgctgctgctttcctgcttgcacatgttatctttgcttctgccggtcctcagtctggcgtgctttctttttctcttcgccgtctcctgctcctctccttattcattaatttcacctttttggaggtgtacagggtctcacacataaattattgtgcatggcatggagaatgcagaggtgagcctgtcgtggcaggactgcaccagtgtatccacagtcctgtctcggaatcatacagaccctcagctgacgtcgggatagcaaggctagaagcctagaagcagggcagcttccttcgccagaggcctgcggtctcccacttccggcctagtctgccagcttttgctggcacgtaggctaccactctccgggcaccggctggggccctggagccccctttggggcggagtggggaaggtgtgagtcagcgcccctggacgggccgggctaaaaaaggctgttagaacctttgggccgtgcccccattttccgtacatggtgaagaactgcagccgggcttgtgtgcacacgccacacactgggcgttcccggcacgggagaggcccagagtttccttcaccctgggaacagagccctacagccagggcttatatggccagcgggactccaaccggggtagccgcgaggaaggcgctggcagaggacagaaatgtccagtcacctccgctgtcaccacatcctgagcactcggccccatccccccacaggagggaagctgtggtctgacggaatgggcaactttcg

SEQ ID NO: 2334 - DNA, 28312 bp, Homo sapiens; identical to SEQ ID NO: 2331

SEQ ID NO: 2335 - DNA, 28250 bp, Homo sapiens
atgtggtccatgcctgcctcctgctggggaggggagggcaggaggtttattgagcagttggggaggggtgggaattcagagggcgtggacgcaggccatctcgtctcccaagtcctcctcatcgaagcgggagaggatggactcctcgtcgctatagagagagctggttccctgtgccagcaggtcactggcagcattgtccatctcatccagcgtcaggcgacacgcatctgcaatctcctgcttggccagggccacgaaacgtgggtctcgagcaaagaggcccagaccctctgagataagcacctgggggcacaggtgggatcagtgttgacggacggcacagtgtgcacagaaggttcagtgtggataaatgacgtgcccatgagggcatgtagggaagtcagtgggggacaggggtgagcagaggtcgtagggcaaagggatatctacatgcacaacacaggacctggggactcctttccgtcctcctccagtacccacctcctccccttctcccccatccgtcttgtctatatgccctctggactcacagcctccaccaagctgtcggcactgcccctcttcccatggctggggtccgagtgggttccaggcacgtgcagacaggtgaaggtgcgcagtgggccactggatctgccgaggtacccctcccccgctgcgccctcttccaccaacaacagcggggcatacaggagccgaccccgctgaggtggtgttgcccaggaaccctgagccagaataaacatcagaggggcagggatggatgagtagggtatgagggtctaggactcaccgctgtgcctacttctttccctcagtatacaactggagtgaaattgaatgggtataagtcaggcttgagtttatttatgtaagagtgcaggaggcctgggtttaaatgtcagctctgccacttactagctgcatgatctggggtaaacctctcaggacctcagtttcctcacaagtacagtgagcattgtgtgcattcattcatatgtgtcctgttcttcagaaggctctgaggccaggcgcggtggcttatgcctgtaatcccagcactttgggaggctgagacaggcggatcacctgaggtcaggggtttgagaccagcccggccaacatggtgaaaccccatctctactaaaaatgcaaaaattagccaggcatggtggtgagcacctgtaatcccagctacttgggaggctgaggcaggagaattgcttggacccgggaggcaggggttacagtgagccaagatctcaacactgtactccagcctgggcagcagagcaaaactctgtctcaaaaaaaaaaaaaaaaaaaaaaaaaaaagggcctgatatgtgctgtgtttgagaaattcagcctaggctgcccccatctctccagaccccagaccccagcaccacctccacagcctcacctgagccctattgggccctgaatttcgcccacgatgataggtgcctgggatgggtaaatcctcacaactgccctggcgctgcagacactggatggtgaaggagggcttccgacctgggggtgggtggggcaccaggggcaaatagcaatgtcagtgcttccccagatctctgtcctgcaggcccgtgggggccccttggatccatccctgctctcacctgcaggtgtggggggcagcagacggcggcgtggtaccaggtgcccatccatgtatctctgagctctgtgaggtggcaaaaggactgagcacgggggagtccctgcctgctcatctaggtaggaaagcctgtgtgggtgggagggccaggggtgaacttgggtctgggcctggacctgggcctgggagatggggcacaaacagtcctccccgacccagttcccacccctcctccaccccagctcatgggttcatcccatgtggcatggccagtgtaccgatcagggacttcctcatcctcatcttgcttgttttgccctttggttcccttgggctgagaatttccttcttctgggatggtgaaaatgagagccccagagcctctcctggggaaagggaggcacgttaggcagaccagatccctcaatatgtggccctggacccctggttcctctcatcccatgccccaacccttacagaaacactgggcttttggatttttttgttgaggacaagtcacataaaattaaccattaaccattttaaagtgaccatgggcttttgtttaatagatgttcatctaattaggactgaaagtttcaaaaaaatcaaagttgacctgtagagagacaccttgaacacaaaactgggcatgtattaggagtggggggagcctgtaaaagctaggcactttatttttttatttctattttttattttctgagacgaggtcttactctgtcacttaggctggagtgcagcagcatgatctcagctcactgcagcctcaacctcccaggctcaatttatcctcccacctcagcctcccaagtagctgggactacaggcatgcgccaccatgctcggctatttttttattttttgtatggacggggtctcattatgttgtgcaggctggtcttgtactcctgggctcaagcgatcctcccaccttggcctcccaaagtgctgggattacgagtgtgagccaccgtgcctaggcaagctagacactctgaaatttttttttaaaatttttctttaatctgcttatgtattgtctagcagctaagtgtttgacatgcattacctcatttcatcctttctttatccctgtgaagtaagtgctttgtcatcccccttaaacaggtgaggaaactgaggctcatagaaacgaagtgactaggcagggcacggtggctcaagcttgtaatcccagcactttgggaggctgaggtgggcagatcacctgaggtcaggagttcgaaaccagcctggccaacatggcaaaacctcgtctctactgaaaaaaaaaaaaaaaattagcctggcattatggcgcacgcctgtaatcccagctactcgggaggctcaggcaggagaatcgcttgaacccgggaggcagaggttgcagtgagccgaaattgtgccactgcactccagcctgggagacagagcgggactctgtctcaaaaaaaaaaaaaaaaaaaagtgattagctcaaggtcacttagcaaatggcagaggcagaatgtgaactgaaactcttggtttcacacaatgtgctttttgcattaaacctttgtattgcctttctcatatgaatctcttatcaccctctattcttacctgagcccttgaaacacctccattcttcccaaatttctgcttgaaggcctctaggccctccctcccacccccctcaacttcctgcctcctgaattgcctctatccagtgtctagtccttgccttccctcacaatctacttccagacacttgataatacctgtgggtgttggatccagcctggggcacactgggctgactggaggtgggagtccccctgtcatcatcactgggcccaaaggagagtgaatctggaagtctgtccccgacaggcagagacacagaaatcccggagccccggcgagctgagggctgggagaccatcgtggcctgtggagagtcacaggactgagtgttgcatgcactttgtggctaagtcatttggtcatataacatgtctcccccacaggtccatgaatgtgggccttgccctccaacagcaatggtaaatgtcaaataaataaatacgtaaataaataaataaatatttgcgatagggtcttgtcctgtcaccaggcgggagtgcagtggcatgatcacagctcactgtggcctcatcctcccaggttcaagcaatcctcctgcctcagcctcccaagtagctgggactacaggcttgcaccaccactcctagctaatttttaaatttttttgtagagaggcggtttcactattttgccaggactggtcttgaaccctagggttcaagcgatccttccaccctggactcccaaagtgctgggattataggcatgagccaccactcccagcctcaaataaatatttttctattgcagagggggcttctctgggggagcttcttcccagaagcagtgtcaaaatcactcaggggattgacgaagtattttacaatcaagttcctgggagagtgaaaacttgtccccactttgttagtttccaagtccttttcatcttcctcctccactccctcctgcccctcttcttcctcctcctctgtgtcacaggtgagggcctgccgcatctcaggacccaagtcctgcaggctccgcagaccagcctgtgggggtggagaaataggtaagcaggcagctcagggtctgaactttccctctgtttcccctgcaggcgggtagggtgggggaaggagtccttcagccaccctggccctccgtgaggcctggggcctcagtttccttatctgtgacatgggtttcacaagatcaaaatgggggtcagcctcagccacagcactgccacacgtgcccatccacactaggccctgccccgaagacctgaagggcggaagaggtgctaggggcggcgtcgttgcctagtagccctttttctttcctccgccggaatttgcggaaatagtcctggatcagaaatgtggcgtagaatttgcccacggtgacctcctcctctaggggcaagggagagaaggcaagatcacacaggggccctctgacccagcccacctcgccgcctctctacccaccagcatggacttcccctcgccctctgcccagcgctggttttgtggtggagagcgatcatctgccattcaggggctggcgcggggaactggggcggggatagctcaccgtctggtggggggatgacctcatctagcagcttctgtttcatccgcttccagatctttttgatgacaatccgcagctcctggttggcttgctccaggttccctgcgttggaggaggatgtggggcatgagccaataggaagaacctccacagctgccccctcactgttgggtggggggaacttcacaagctgctaccgcagatgcacaccgcccccattggacggggtggggggaaacaggcctggagaatcctgtcacccattctggggttcagagctaggagtggggcccatgattcaatgagtttgctccttgcaccctccccaggaacgatcccactcctgcccctcccctacaccttctgttttgatcttcagggatgtccggaccagggcaaagagtgtggcgttgaatgtcaccgtcccatctgagttgaggggcatgttcattgccacaagtctctgcaaacacgagagacatgaaacccactctgggaaaatgccgggtatgcaggaacgaatgtcaaggggcagaaacctctgaggatgcgatcaaacacccctccccacccaaggcagatcccttcccacccttgccatgtgatagacagttctctcaggagcctgggggtgggcaggtgcacagaccttgcaggccactcggtgtgggcacagcttcccaaatcccagagggggctggatacgtctcagcagggcaaccacatccaagtgtttgatgcggcccctggaggagttggggaggtaccactggattggcgatgcccccactagccctttctcaaggccccaccagctcatcactacctcctcctaccaataccccagagcttgccagggaagaactggagggcagtcagagagggcagaggatggggcagtggaaactttggggcatctattgactgggtaatgagatgcagcagtcggaggtttgggggctaggggactgtgtagggcaatacattgtcccctggattctaggtaagggtatagagggcatacttggccccagggtcatattcagaccagatcctcttgaattcatcaaggtgatgggggcccaggatggaccaatctctggtgagataatcaaagttgtccatgatcacagccacaaagagatttatgatctgtgggccagtgagcaagggagcagttaggtgaagggcagaacactgtcatggacggatggtgggaggctggggcgggcttatatggtcatgagtctctgggttgatcttgtcatcagaccagccctctcacccactatgaagatctgggctgcccacgtcacatccctgagcccctcagggccagcccccgtgacggtggtggtggttgtgaggaaatggttctcaccaggaaggcacagagcatgaagaagctgatgaaataggcgatggcaaaattgctaccacaggtaaactcttcaccagggccgaagtcagactcaggatcacaccgatttccgggaaggctggcaagcattatctcctgccatgcctcaccagtggcacacctggtgggagtcacacaggggtagcatcctgaaggggaggctatgaagtcatggtaaatggagttgggggaggactggggaatgaggagatgacctacttctcaccaggggctacatctggcacagataacatttcaatattttaacagccagtgtggccatgttgacgacagtcatgtttgcatcttacagatgaggcactgagacctgagaaggggaggcgtcttacagtcagaaagaaaatggctgaggctagaatactctaacagactcctcacatcatagccaggaaacatctcgggctgtatggagccccatgctgccatattattcccatagctcaagcagtctggggctcagagagggtgggtgggcacccacgggcataaggtggcaggggagtgagtagatgtcacctgaacagaagcagcacagcctgtggaaaggtctggaagttgttgtttcggtttatctgtgtgccatcctgaagagccaccttgccgaacatctgtggacacatcaaggctgtgtcagtggggtgaacccatgccccacccatttcacacctcctaatacctaaaggagcctcataaccctgacaaacagggcatcactgctgatctcatttcacagatgtgtagattgacccagggccgtccagcttgtctgtctacctgccacccctactttggggctattcttaacccatcccctgccagcagaggagtgcttaagggatgcttcctagggtccccacttgcctgcatgccaatgacggcatagatgaagaatatcattgcgatgagaagagccacatagggcaaggcctatagggatgggggaggggggcagagaatagatgcacaggctcaggcaaagaactataagccccagaatgcactgctttccctggcctgggcctactgggagatgcagtccatctccaaagtgccaaggactgtggtgtctctcaaatgtgaacatagtgttaagtagatagagtaaggtcagtgagaccagaggtgtgttggaaactgagagcccagaaaaaagagaaaattggaataataatttggaaatgggtatggcatgttgggagatgtagttctgagggtggtaaaggggcaggctgagaagtgtgaaatgggggcgaggtatggtcaaagggatggggtaggggattacctggaaggacttgatgaatgtccagagcaatgtgcggatcccttcacccttactgagaagcttgaccagccgcataactcggaagaggcgaaagaaggtaatggaaatgcgggagctgtcctcagagctctggggtgaggggtgcagtagggatgctcagtttgcatttactccagctatctccctatctcatgctttggccctcccagtacccaaatcactcaggccctagggtaatccggagggatggagggacagagggacatgggaaaagaagcagagagtccctgttattagggtgggctacctcgccaaggtggccaccattctggagggagatatggccaagaaaaaggtgatacaggagatgatgacatcataggcccaaatgaacaaggtgagatatgatggagcagatatagggggtgatggtggggtcattacacaggggacaatgggaaagtttatatggtagtggattaggattaggaaaaagtgggtaatgggaatggaagggagaggagagagtaaaggaggtgatggatcagagacattggagccaatagaggaaatgatggaaccagtggtgtcatagagatgatggagatgagagaaccgatggagaagccaatggagaagccagtgatggagatagggaaccagcagcgttgtcagttgaggtgacagaaccatgtagtacccaatggaggtgatggagccaatgatatagtcaatggtgatgacagagccatgaaagagccagtgtcagagatgatgaagttggtggagaaatgaagccaatgaagtcatcagaaaagatggagccaaagcaggagccagtgaacatgacggagccaatggatgggggatgtagaggcaatgaaagagataacagaaataacaggagaggcatttcaggagatggtggagccagtagataggttacaaaatggaatgagaaagccagtagagggggacttttgctgaacccaacagggactcagaagagatagagctagaatgaggactgagtctccaggagtagggaggatgtgcgtgggagccacccacccacgtgaaagggaaccccgggatagaggtgagggaaggtgtatagggcgagagtggattagtggaaaggccagttctcacattgacttcagtgacggcaatatccactatgctgcccaccacaataagagcgtcaaacgtgttccaggcatcagtgaagtaatgctgcaagtaggagaaaagcagtgccctgtcttctcaaagctcgcaagccagggtagggggccagtagtagtagggggcgccggaggggggcagggcttcgcttggatcacacgatgggcctgcacctgagtccctctcactccctagactcacactccctggctgctgcccgcatcgccaaccccagagctctgcaatgagctccactcccaaggaattcatccactggtgggtggggctagagaaggggggccaccttgggcttgaaggcgatgattttgagcaccatctcaatagtgaagaggccagtgaagaccatgttgaggatgtccatggcatagttgaagggagcagtctgctcatagtgctgcaggagaaaatcaggttgagatggagcctgaggcagagatgccgccacacccaaccaaatattccctggcctgggctgaggcgagtctggggacttgattgcactgtgtattggtcaaacctcttgcactgtctgcctcccattatggatactggaaagtttagttcttgattactagcttttcttgtagttaggcaaggccaggttgactagtgagacataaacataaatctgctgttggttagcagcttgtgtaaaaaaaattttgctttccgatgaaaggatcaaataaggagaggccccaggtgcagctctccctgccttgagtgtggttttgatgcctggagctgtgatcatgaaacaacaatcatgaaaatgaatgccaacttgctaagaatggtgaagcagaaagatagagcatgggtcccggatgaacaatgaacaaacagcctacctctgcacttctcaatacatgaggtaattaccacagttcattgactccaggaggcacatctttttacattttagaatctctgaaattggggcgcattttataacaaatggcaacttacaatggccactggctacttttttttttttttccacattcttacatctccgaaatcagaatgcaacttacaagtactggccatagacttaaagaaatgtggcaaatgtctttatagcttaagttgctgttagttggcagggggtttgttatttgcagccttaaatgttcccaatggttcccaagggattatgtggagataatagggtcaggagtctggcgggggtcaggcagggatctcagacctgcatggctagggcaactgtgttgagcaggatgagcaggaacatcaggtactcaaaggcagcagagttcacagtggcccacacacgatactgatgcgggttcttggggatgtaacggcggagtggctgggccttgagggcatattccacacattgacgctgcataccagggcagggcatgagtgagcagtggggtcctgaggcaaggagggaagggttggtgaccatccatagggggtcaggggtcagaggtcacctggttcttgtccagctcacagttttggtactcctgctcgccctgggcacggaaagtgatgatgacgaagcccacgaagatgttcatcatgaagaacgcaatgatgatgatgtagacaatgaagaacactgagatctccacacggtaattatagatggggccatggtcctctgcatatgcatcgatggccttgtatagcagtctgtgggagccagagggggggtagaggtgggggcaggtgaggggatatcccagccccctcagacctgcccccagtctacttatcacagacaccccagagtttcctgcctggcaccccaaagacccctaaatctcctgacctaaccacctgggacctccatacatactctaagagacctctaccaggccctcaaagagtccaaatcctctgtcccatgccctcagaaacccccatagagtcctccagagaatctccattcagaacctcaaagacccagaaatcccctaagtttccacagaccttcaaatccccttctccaaccacttggagacccccatgcgcctccccagaacttccacacaagcccccaacgatctgtaaatttatccctgtcccatcaacttgaatccccactccatctccccacagagccccacaatgagtatcccaaagacctgcacagctttctagaaatcgctgaatccctgcttcatctcttcagagaccaatcccagtcccctcagacctccactctgtccccccaaaccatctccaatcctttccaggcttctatctagctacctagtcccttagaaaccgctgtccaattcctggagacccctcactcaagtccccaaagaacccccacccagcttctgggaactccacctctacagtcctctgatacacccaccactctccagaaaaccctatccagtctcgagagaccttcgtcacatccccaaggtacactcccacccattcccaggagatcccaacccaatcctgcagagacccctgcctcatcccctgataaacccagggccctgtccctcacgcaggccagccttcaaaggtggagacagtgaacagggccatcatggctgaaaggacattgtcaaagttgaaatcactgttgacccagagccgctcccggaccaggggccgtgacacgtctccatctgggtataccaggaaggagcccctgtggatgtgcaaacaggttagatgggtgaggaggggtgaggaactggggaaagggtctggggtctccagcatggaggcagcaggacatagtggtggagcaatatgttctaggttcaaatcctgtccctccatgtcctggctgggtgaccttgcgcatttaccctttctgtgcttctgtttccccattctaagaaataaggataataacagaatcgatttcctggcttgtcacaaggattaataaatgtcacaagtcaataaatgagactagtgtctggcacatagttggcatcatttcatcatcaccattatcatcctcatcatcgcccaccaggaaaaagtaaaacgaataatagccaacgtttattagcagtaactatatgccaggcactgagctagattttctttttcttctcttcttttctattctctctttttttttgagacggagtcttgaaaaagactctgcccaggctggagtgcagtggcatgatcttggctcactgcaacctccgcctcccgggttcaagcgattctccctcctcatcttccagagtagctgggattacaggtgcacaacaccaagcccagctaatttttgtatttttagtggagacggggtttcaccatgctgactaggctggtgtcgaactcccaacctcaggtgatctgcctgccttggcctcccaaagtgctgggattacaggcgtgagccacagcgcccggcccaagctaggttttctgtgtagcaactttacattgtacaaagtacattttccatgtagtagctcatttactcttcacaacagccttgtgagataggcactgtttagccccgtttttcagttgagtgaaatggaactgagtaagtttaagaaatgtacctaagtctcatgaagtggatttgaaccgtaatgtctgacttcacagcccaggcttttagctactaccctctacaggagtctcaagatggaagctgggggctcagggtgggaatggtgattgctaatgggtctggagtggaatgtaggtcacttggggaatgcggagagggatttgggggaggtatcgggggccgccgaagacttggtgagatctgagggcctctgcagttcttgggacaattctgggactatatctttgggccttggtgagatctagaggctctaaagtctttgggaggggtcctgagctccgtggacggcagggtcttgggcactcacttgcattcttgaggggtgtgtttggcctcgtccgtgcaggtgtagaatttcccctgtagagaggatgtctgtcaagtaggttcacccttcatcacactcccgcccagacccctgcctggcattccctccagtgtttgccccaccttgaagagctgcaccccgatgcaggcgaacataaattgcagaagtgtggtgacaatcatgatgtttccgatggtccggatggccacaaatacacactgcaccacatgctgcgggcacccaagcatatggctactgaacactacaggccacagtggtcatggggcagggactctggtcatagatgcagctgagggacttgggctggggacatgtggtgatgggtcagggatgtatggttagcaacatgtgttcaagaggcagtgttatgggctagagacgtgtgggcatccaccaggaataagtgtttgccgggtggggatctgtggccacctgtcagggagctgggtctgagaaatgtggccactggtagaaacatatggtcacttggaaggaacatgggtcaggccacatggctagtggtcagagatgtgtatttatgtgtcgggtccaggccgtatggtcatgcatccgtgcaaatggtcagtttgatcagtgatcctggccccaggggcagggcagggcctgggtcctgtgggtttgggtggggtggggttaccttgagtcccttggccctgttgatggctcggaggggccgcagtactcggagtactcgcagaatcttcaccaccgagatggcgctggagctggggaaggggcaatcctcaggcattggccctggctgggccctggctgtgagaggaatggggtgggctggggatctgtcacttactggatgccaaaggagatgagggacacactgaccaccagcagatccaacatattaaaccagctacggcagaaggagccgcggtgcaggaaggccccaaacactgtcatctggggacaggacaagaggctagactcagacctggggatggtgggggttgggggaggtggggatggggacaggagaggtgggctgcaagaaccggtggggagagtgccagggcaactgagggtaggactggggtcccattagtcacctttagtagaatctccacagtgaaaatggaggtgaaggcataatcgaagtaacccagaatctggggtgtgagaaagagcggggagccactgagtcacggctgagggggatcctaggtgacttctcaaaaggcttggccatcagaaagattagggttcaaatttggacccttctgcctctacccagctacatgggcgcctttggcctgcttaacctctctgagcacagcttcctcctcagtcaaatattgatctcctccctggtgcttccccgtgtgttgcacatgccgtaaaggctggcattgcatcagctgcgttaatgagcccctctctcggctcacctagggctcttctccttatctccaccctgacccagcttgtgcccactaggacacccctgggagtgtcccctcagctcctagctcccagccaaaggctcacatggttgcggaaggagtgggctcggatggggtcctcagcggccagggacacactgctgaggatgatgaacaccaggataagattggtgaagacatgatggtggatgagggtgtggcagcccttcctcagcctgtggagagggagtgggccatggtcagaactcaggaccacagaattgttcagggattccaagggatacagttctggccctgacacaacacccatgcccccactcccaccttggctgctcctccatgctcctccacctgccctagcccctcctgcctcaccccctgccacttccggcactcacgggttggtttggctgaggcagaagaaggcgctgccctcagggatgggtaccaccttctccttgggtacaacttcctgcaggagttccacaccccctgcaccctcttcctcttcttcctcttcttcctcttcttcctcctcctcctcctcctccatgtctggcaccagagaaaagcaaaaaaaaattaattgagcaagttgatgtaaagcacccagaacagtgtttgccacgtggtcaattcttcccatttccctgctagaatgtcagctcctccaggaaggtattttagtctgttttgtatgctgctatgtccacagcacttagaacagtgcctgggacacagtaggagctcagtaaatgtgtgttgaaagaatgttgtatatacagactattttataataaaggctctgagaagttcagcagtaaacaaaacgtgtttctcttcttcttgtttttctttaaagatagggtcttactctgctcccccaggctggacttcagtggtgccatcatggctcactgcaaccttgaacttctgggctcaagcaatcctcctaccttagcctcctgagtagctgggactacaggcttgcatcatcatgcttggctaattaatttcttttttagagatggggtcttgctatgttgcccaggctgcatttcccttctttaacctcaatgttcccaaatgttgctgaccacataccaagtctgttattttcaggatgatcttggaaaaggctgatctctggagaggagggtctcaggggtcaggagctgtctgcctgagctctttccccaaggtcccacacctgctccacctggccctgcccacttgcctgctccttccctccttgcaccctcctcttcctctttctccacaccaggcacctgaggacaggaagacgggagtcatcaatggtgagggagacacagggaatggacacaggggaggcatggaagaaatgtaataataggggaaagaataggcagaggatgaaggttaaagacatgcacatatggctgggcgcagtggctcatgcctgtaatcccagcactttgggaggctgaggcaggtggatcacttgaggtcaggagttcgagaccagcctggccaacatggtgaaaccctgtctctttcaaaaataacaaaaattagccgagtgtggtggcgcatgcctgtaaatcccagctacttgggaggctgaggcaggagaatctcttggacccaggaggcagaggttgcagtgagccgagatggcacaactgcactccagcctgggcgacagagtgagactctatctcaaaataaaacaacaacaacaaaaaaacagatatgcacacatagacaggtagtggtgggagtgggaggtgtagacagtgcccaggcatctaactcaccaggccttcattctcctgtgggagatccttctcattgctcttctccctgtgcgaggaaataggggtgattgctgcagatgggctaagggggatcactacagtcagaacagacctttcttgggtcccatagaactttcttgcttccgctcttccccactgcccctcccaacagtccgttctcaaagcagccagagggagcctgttaaaccctgtctgggatatcccaactctgcccacaaccctcccatgtctccttaattcaggaaaaactacagtcctcaccctggcccagaatgccctcaatctggccctccatttcctccactgaccttcactccataccactctcctccttcctcactccattccagcctcactgtttttatttttttgagacggagtctcactctattgctcaggctagagggcagtggtgcgatattggctcactgcaacctccgcctcctgggttcaagcgagcttgtccagctaattttcttttgtatttttagtagagacagggtttcaccatattggccaggctggcctcgaactcctaagctcaggtgatccaccctcctcggcctcccaaagtgctgggattacaggcgtgagccactgctcccgggcatcgctggtattttttgaaagtgctaagaatgtggtcaggtgcggtggctcacgcctgtaatctcagcactttgggaggctgaggcgggtggatcacctgaggttaggagttcaagaccagccttgccaacatggtgaaaccccatctctactaaaaatacaaaaaaatttagctgagcatggtggtgtacgtctgtaatcccagctactcaggaggttgaggcaggagaattgcttgaacctgggtggcggaggttgcagtgagctgagatagcaccactgcactccagcctggatgacaagagtgaaactccatatcagaataaaaaaaaaaagtgctaagaacattagcgccccagaagctttgcacttgccactccccttccttgaatactcttcccccagatatttgcatggctcactccctcacttcattcaggtctctggtgaaatgtcacttcctcacagagaccttccttgctgaccttaaccccaaagagcaatcttcatttcttgctatcctttcattctgttttctctttattacatattattaacatatattatatattcatttgttttatttttcttgccttcctcaactagaatgttagttccatgaaggcaaggactcttgtctgccttgacccctgttgtctcctcagcatctagaacaggacctggcacacagtaggcagtcaatagatgcatgttgaatgaatgaggactggcagatggtatctggagatggggattaccagggtgactagaggcatctctggtggtgggggtgtctgaggggttcccagtcagggatcccagagagagactgtgttaggggtggagccagatctcacccgcccttgtccttggcagtgcctgcatctccactggccaggttgtccacagcaatggcaagaaacacgttcaacaggatgtctgggatgagcttaggctgcaaaggatggagaagcaccctgcctatagaccacccagttccccttacccaccccgactccaccatcatccagccccacaaagctccaaggatacagttgccacagatgaagagaatgatgaaatagatgcacaccaacattcctgggaagaaggggccaccatatgccatgataccatcatacatgaccacgttccagtcctcacctgtcaggatctgggggtgggaagtcactgtggagctcttggaccccctccaactccagggtctccccgacccacccatcccatggtctccagatcctacctgaaagacagtgaggagggcctgggggaacgtgtcaaaggtgcttcgcttggtgtgggtctggtcaaagttgaacttgcccccaaacagctgcatgccaagcagggagaagataatgatgaagaggaagaggagaagcagcaaggatgcgatggatttcattgaattgagcagggatgccaccagattgctcagagaagcccagtgtctgcagcagaaatgggagggggcagggtcgatgccatgtccactggacatggctggagcatcaggagccagggcagggctccagcttgagatgcacctcggcaggttgggctcaaataggctttggtgtcagggttagaaatgattttggagttggggtgagatgagagtaagaagtgggggaagctgggccctgtggtggctcacgcctgtaatcccagcactttgggaggccaaggcgtgtgggtcatgaggtcaggagactgagaccatcctggctaacacggtgaaaccccgtctctactaaaaaaaaattagccaggcatggtggcaggtgcctgtagtcccagctactcaggaggctgaggcagaagaatggcgtgaacccaggaggcggagcttgcagtgagccaggattgcactgcactccagcctgggcgatagacagagactctgtctcaaaaaaaaaaaaaaaaaaaaaaaaaaaaagaagaagaagtaaagaggtaggggaaagttgagagtttggggttagggttggtggtaggggtataatgggagactgggagatgaggttaggatggagtttttttttttcttatcttttttttttttttgagatgaagtctcactgtgttgcccaagctggagtgcagtggcacaatctcgtctcactgcaacctccaccttccaggttcaagcgattctcctgcctcagcctcccgagtagctgggactacagtcacttgccaccactcccggctaatttttttgtatttttagtagagacggggtttcactacattggccaggctggtcttgaactcctgaccttgtgatccacccgcctcagcctcccaaagtgctgggattacaggcgtgagccaccgcgtccagcctaggatggaggtttaatggaagttggtgaagctagaattgggtttcagcttgggactgggcctggtgttggggatggggttgtgatgtatttggggttggagatggagttaagggtaagttgtggttgagggctgggatagaggaggggatgggatgagactggggctgaggctggaaatggagttgcagttgaagatagggtgatggttaagggttagggacgtgggagttctctttggggattgaggatggtattatggttggtggttagtgacagggatggggctgggagttagggatgaggtgggagatggagttgggcttgggaatgggtgttagcgttgtaaatgggctcataggtgacctgtggttgggggttgggatcagagatggtattgtggttgggggttgggatggggtttgggctgggaatagtatggcattgaaatcggagacagggttggggaaaaacgttagagcaggagttgaggttgaggaaggcaatggaaatggagtagacattctccccagtggatgaagacaggaacttgtgtctgctttgattcctggtgtttccctagggcttggtagggtgcctggcacacagcaggcactcaatggatgtctgctcaatgaatggtgaagcagatgaagttatcattggagcttgggtgggggtgttgaggctgtgtttgaggcccttgtcttccccctcccctaatacaaacctggtgaccttaaagatcctgaggaggcgcacacatcggagcactgagatgcccaagggctgcatggcgcccacctccaccaaggtggtctctaggatgcccccacagaccacaaagcagtcaaagcggttgaagaaggaagacacataggcagaggggcccagaccgtacaatttgagaagcatctccaccgtgaacagacagagcaacactttgttggcatactctgtggggagagaggcagggatgatcgggctggccagtttctgtggtgacatgtggggaggtaactagggaccatggggtgacccacggtagctggtatcaggccaggtgctggctgagggaaggcttagggctagggattggggtgagtttgtaggtcagagtaggtgaagttttgaggggcttggagatggggatgaggggcagagtcggggtgggggccagagtcagtgtctatgagtccagaagacccaaattcacaagtagagttagagtctagggtttcttcgggactggggctggtttgtgggttatgggttagaaatgtgctcggtattcaggctggggctgagattataatgaataatagtaagagctgacacttataaagtgttagctatatggtgggccatacaatgtcctaagcacttttcactttacatcatttactcctcttcgctgcttcatgaagtggatactactatctatcatctccattttgtagatgtggagaacttttccagacagtgtgatgataagagcctggattctggagccaggctgcctgggttctaattctggctctgccactcgctagctgggtcccgagattagtcgcttaacccctcagtgccttgatgctcagtgttctgtgccttagtatttaattcgcataaggttgtggtgaagaaattgtcagtacacataaagaaaggtgctgagaaaggagcttgaggcacacagcaagtgctacctgtgtaagctacaaggtgggatgggacaggctaagggctctggatttatttgggtaggggggaaggcagtgtcttgggggctgaggcgccctagaggttttggatttaagcttctggggtagaaggaataggaggctgggggagacgactagcaggctgggggtgtaccctggatctgggtgagccacacaggctgcccgtggtgctcagaggcgatggtcaacgtgttgaggaagacgagcaacagcacagcccagtagcaggcattggacttcactgcccgacggcagcgtgcccgaaggacccggttggctcggcggaggcggcggctgggggaaggggagcccacaggctgagatcacctacctaagcctgccctggggggctcaggtgggggatccaaaggtcatgagggcttggaggtggggggtttcaaagttatggagtcaaggatttgcacaactttcccaactcaccagactctggttttcatgatcttgtttctgaaaaagaagggggatgggaggtgtgtgtcgtaaagggcagaaggggtgtcagtgactggggccagaggtcaaggactgagatcgaggcttgaggctaaagaaaggacttgagtcagggtttggactggcttctgggctgggtcaggggctgggggccctcacaggcagcgtgtacagctggccagagccccctcctcctcatcctcatcgccttgggtctctgtcatggaaccggtgtcactggctgggaggctggctgtaggcaaggtggggatagtggtcaggacctgaagaccccgaggtccaatctttggctttcacctctgcctacccacccccaccccagcctggctggacccccaccatggctgctggtggagtgtgtggagcgagtagaatgactgaaccagcgcagacgtccacgcctcctattggtcagctcggccagctgtggccctgcagggagagaaaggacaattagggaggacatactgggggcagggttagggccatgtctagggtaggggtgtcatttggagtctttatagctgaggctggtcttgattctgcattttgagccataacttgggggctggggctagagttgttgcagatcaggcctgggtgggtctcaggagggcagaccacatctaaggcatgcagggaatgggccagattggagttgcctacgatggcccgcccggccctcttcagccatagaaccaaggttgtcatcggcggaggggtcctccatgtccagctcttcggcttgagtgatccagtccaggtagccccgcaggtcttcctccatctgctgcttctcccgctgcttctggaagtccccgcgagctttcgctttctctctctccttggagaactccctgagggaggaggatagagggctagggggaggagccaatctgaacaccttgctttcatcactccagccacactagcctcctagctactctttgaatatgccaagcacattctagcctcagggcctttgcactgaccattctctttgcttggaatgcttttccctcagataaccacatggtgcacccacctcatctctttttttttcttttccccagatacagggtctcactctatcactcagggtggagtgcagtggtgtgatcatagctcaccgcagcctcgacctcctgggctcaagcgatccttccacctcagcttcctgagtagctaggactacaggtgtgcgccaccatgcccagctatttttgttcattttttgtaaagatgaagtctcactatgttgcccaggctggtctcgaactcctgacctcaagccatcctcctgccttggcctcccatagtgctgggattacaggcatgagccactgcacctggcctctttcacatttttactcaaataacaccttgtcaagacagcctttcctgacatccctatttataatcacaagatctctccattcttatcttttatctttcctttctttccacagtacatattccatataaaacactatatatatgtgtgtgccaatatataaatgcacacacttattttattgcatatgttgctactttctgtctctccccatcagaatgtaaaaccaggaaggcagagatttttgtcttttgttccactcctaaaatggtgcctcacatacaatagatgctcatgattgaatgaaggagtatttcagatgggttttgaaggatgtctaggagtttgccaggcacaaagaagtgggcagtggctgaggggtgggaagcagggagtgtctaggtccctcacccactcaggacgccaagcacaaggttgaggacgaagaaggacccaaagatgacaaggctcacaaagtacacccagggcagttcataccccatggcatcttgcatctggggagagaaaaggcatgcatccctcagggtaggcagacactcctgcgtgagtgtcagggaggaaaggcaggtgcagcctttgagctctgtgcccacagtccacctcacccagtagagcacatcggtccagccttccatggtgacacactggaagactgtcagcatggcgaagaagaagttgtcaaagttggtgatgcctccattgggccctggccagcgcccgcggcactcagtctggttcagcgtgcacgcacgccctgatcccgaagacgcacagggcgatgggtcctcctccgcttccatgtctgcaggaagactggagcttggggcttcgaagcaggcccactctcagtcgctgccaccctgaagccccgcccacttaggaagctcgacttgggtcctagatttttctctttctctctttctttctttctttttttgagacggggtctccctctgtcgcccaggctggagtgcagtggcacgatctcggctcaccacaacttccgcctcccgggttcaagcaattctcctgcctcagcctcctgagtagctgggattaccggcgtgtgccacaacgcccggctaattttttttgtatttttagtagagacgggggtttcaccatattggtcaggttggtctcgaactcctgaccttgtgatccgcccgcctcggcctcccaaagtgctgggattacaggcgtgagccaccgtgcccggccagtcctagatttttctaaggcaacacttagctccacttctagggcagaaccctgcgagctccgtattctgaaccactgggaagctagggatcccaccaaccgggatttaaatcctggcgtggagtcttgtaaataacaatgaggcaagagcctgggggcggagtcttgtgaatttggacgcgtctcttgaaaataggggaggggcaaggcatgggcgggagtctgggtaaatggtctgagtgtatgagaacagtcgtggagaataaagcttttttttggtttgtttttgttttgtttttgagaccgagtctcactctgtcgcccaggctggagcgcagtgagtggtgcgatccgatctcagctcactgcaacctccatctcccaggctcaagtgattctcatgccgcagcctcccgagtagctgggattacagacatgcaccaccacgcccggctcaactttgtatttttagtagagatggggtttcactatgttggccaggctggtctcgaactcctgacctcaagtgatccatctgcctcggcctcccaaagtgctgggattacaggcgtgaaccacggcgcccagccgaggataaagttttttaaaattgtttttgttattattttttggagactggatctcactattttgcacaggctggtagcaaactcctgggcgtaagtgatcctcccgcctcggcctcccaaatgccgggaatacaggtgtaagccaaggcgcagagtttttgttttgttttgttttgtttttgagacggagtctcgctctgtcgcccaggctggagtgcagtggcgcatctcggctcactgcaagctccgcctcctgggttcacgccattctcctgcctcagcctcaggttcacgccattctcctgcctcagcctcccgagtagctgggactacaggcgcccgccaccatgcccagctaattttttgtatttttttagtagaggcagggtttcaccgtgttagccaggatggtctcgatctcctgacctcgtgatccgcccgcctcggcctcccaaagtgctgggattacaggcgcagagtcttgtcttaagtgcggggcacttgcacttaagtcttaagtgcggggcaggaccttagcctgtgggtacagtctcgtgatggggcggagctattagcgaggtggggttgtagtctgatttagggcagagtcttgaatatatgggtgggacttggttatctggggatggaacctgagcctgggggccgaatcttgtgcatttcagtgggtttccctgagtgcagcattggatctaggaaccgaaggagggggcatgttctgcctaggaggggcgggcagactaaccggatcccaggaagtagcacgtcttgtgcattcgtccaaggaacagctcgagcccaatgatggcataaatgatgatgacgaagagcacgagcagtgcaatgtgcagcagcggcaccagagccttcatgatggaattgagcactatgtgcaggcctgcggggagggagggggaggcagaaataagggcggggtcagctcagccccacccccaccctccacctccgacctcgggggatgtgccactcactcgggaccccagacaccagcctcagtggccgcagcacccgaaacgccctcaatgccttcacatcgaagcctcctggctttcccccggtgtgcggggcgtcgcctggccgtccggggccctgctccagcagaacgctgaacagcctgatgggggagcaccgggcagggaggcggaggtcaggccttgggattcccccctccaccctaaccttctcagaaaagcacaagtccctgtaactagaaatagaaatgggttttaataatattcctgattctggctgccgaatgggggcggtctgaaagagtcgctttcctgagcccagaattcagcgggcctgacggtaggaaggcgactagggtggggtgcctcccgcagacgcgcacccgaccacgacgatgatgaagtcgagtaggttccagccattgcggatgtaggcgctggggtggagcaccagcccgtaggccacgatcttgagcaccgtctccacagtgaaaatcaccaggaatacgtactccacctgctcctgggggtgggaccggggggcgggtcgggaagtcggggagttatttgaaggcgaggtttgacgggggcgtggggagcatagtcaggaccgagggtggggctgagccaggcagggccatccgggtcagagagggggcggggtctggctggaaggagtgagctctactggggctctatttggctgggaactggctggggcggggcgggccttaccaggttgtggttggcagtgttggagtcgtcctcagggaaggggatgtaaactcccagggccacgcagttggcaaagatggtcagcaggatgaggatgtcgaagggcctcaggtggacacagtcaaggaccctggcagagtggcattggaacccccctactcccttgggaacctcccacccagtgctgacccttgacgcccaaggtgacaggtcctggcattctcgacccctgccctgacaaggccttgactttgtccctcctggaaaccttaaccatccccaactcttgctgtgattcagtccttgactcttgaaccctggtgacctttgcctttctgaacctgccccccaacccagttcttgactcttgaccttgatgatctcagccctcctctgttccagccctgacccaattctttactcctggtaccctgatgacccttacccctgggccctgcccctgccttccaggatgcttccactccacgatgctgatgcaggaccgtcgcagaggattggccagggtgaggcagaagagtgcccgaggtgaccgctgggcactggccactgccactgtcttgtgcttgctgtgctggtttcttcgcttaggggtccctaggcctgatgccccactgctttcaccttccacagctgggggcccggggcacagcccccattcgggaccagggcctgccccattggctggactgggctctggggtggtgtctatatggagaaactgtgtcagggagggacagggtattggggcaattgtggctgcttcctacctgatcctgtccctctgtttgaaggaaggagagaagagcatggaaaattagggagaactgggagtagctgggttaaggactgggaagtaagagtgttcgaattaagattagagtgagagtttataggggagtgaaggtgagattacatttccaagtgaagtagggtttggtgtttaagttgggggtagagtttaaattgccatggggtgggcgaatttaaggttaaatttgagtggtgggttttgggttagggtggggatgggtttagacataggtaggagtggagttttgtctaagggttaggactgggtattttgaattggaattagaattaggatacaggttagggtcgaagttgagttttgagtgggacttgaattttgcattggggttttcagctaaggccactcccagttcccatggtctcgtttcagcctcagagggcggtagattggcctggttaagattcccagctttggatgaaacaagctgcctgagtttaaatcctgactttaccacttggtagctatgtgttgccttgggcaaattatgtaatctctttgagcctcagtttccttatctgtataataaggatgataataacagtacctaaaatatagcggtgttatgaggattaaatgagttcagaatcaaaagaatgcctggcacatagagttattcccattttgcagatgagaaaattgagaagaaaaagttaagtgacttgctgaagtggctgaatggggagtcacactcagtctaactctagagccctcatggcttactaccaccatcaagtatgtcttctctctctttctctcttttgtttttgtttttttttttaaagggtctgtgcactttctggaaagtcagagactgcaatcactaacagtattgacatcccggggttgaggttgaggttaggtcactttaggtctgtatctggggtggggtttagactctaacaggggtttgccttctggctggtagagtttgtgttaggtttcaggtgggcgtttggataggggtcagagccaggattgaggttgggtttcctttgggaactaaggctgtggatgaggctgagaggccatggggggtggtgtctgggtcaggctgagcgttagggctctggtggcagagaggctgtttggggctggctgggatggggaacagggtgatgtggttcttgtcccctagaggctctctgggggtggggtctgggtgggcaatgggtgggtcagaggggctctaccttgctccaagggtctgcagggatggaaggattctctcacctttcccgccttcagattccgacat

SEQ ID NO: 2336 - DNA, 16188 bp, Homo sapiens
cgtcttctgctcagccgctttacccacgtggagaacgccagggagctgtgagggtgtgtggtctcgttcctgtcgtctggaatatttttcctctactgagattcatctggtaggtctgcaggccagtcctcccggggtctgaagtgtgagtgagggtgaagagcaggcagtgtgcttcgggtgagtccgttgggtcctgcttcgtggtctgtggcctctgagggagaagggcctcgaggcttctgaaagggaaggggctcctggcctctgaaagagaagggccttgaggtcgtcctccttctctcaaaggctgtgaggccaccatctgctttgtggtcgtgaaggggccaggacaaggaggaaggtgggccatggaggggaggcggtcaggggctcaggtgaagaaggggcgattgctgggtgtgctgtcagagggatggaagtccggaggtgccaggaatacccgatacaggggagatccctgaatgaggtcccggacaggtgcgaggagggcgataaagaagggacctggcacctgggaagactgcgggctggtgagtgcccctgagctttgtggagtggggagccccgagtgagaagcatcgcaagatctcacctccgccatggaaggtctggcaacagtgggaaggactgggagaggctgtgcggtccaatcaaacttgatttgagagaagtgaatggctctagtaagtgggagtgtgcccaaagtagcaatcacgagaattatgattcactaatgttttcatgtggagtccacttgtgaaactaaacctcatcagaaatgacctctgccagtggggcgccatggcctgcgcctgtagtcccagttactcgggacgctgaggtgggaggatcccttgagcaggaggtcgatgctgcagtgagctgtgatcacgccgctgcactctgccagagcaacacagggagactgcgggaccaaaagaaatttagaaaaaaaatgtcctctgcgttttgtcacacgccttaagatgattgctctgccagcttggccagcataagtggctttgtaggcactcagaaaaggtacacacatatgcttaactctgggacttattttgaaagtattttcaaaattaaaacgacaagttaacatttatccatggaggtgatggaatatagcagccctttcgagggcatgctcccaatcacggttgtctgttttcagtgtgaaatatgagttggcgaggaagatcgacctatcggtctagaccaagactctatgtagagccccctgaaatgattgggcctatgctggtgagtgcttaaacgttaattcgttgttttctattagcagaaattaatttttgtgacagtattgttgcattagtatggaaatgctgataaaggtctttcctgctcataaaaaatgatgatggcgtctcatgaaggaaacattgattctggagaattttttttcctctagtgttcttcagcttttgcccatgacttctttctcaggctttgtttgttaatgacagattgtacacatgtattccaacactgagtataatagcctccaaagtcctcgtgcgtcacttttctcatagtaaccttcctgtgggtcgagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcatctttatgaatgagaaaatggaggcgctgggattgtgttttatccaagagcccttgactggtgaatacaaaatttgtattttgttccaaggtttgtgtcttcctaccatctatgttgctgtaaaaacggaaatgattttgctgaaaatgcttaaaactcaaaggctttactgtaaggtagcttagtactgacccaagaatagacccagttcagaggagcaggagcagctccaaaaaccgagtcactgaatgtcagccactgtttcctttgattgatgtttttatatggtacatttgataaaagctggataaatgaggatactgccatacaggtagctggtttagttattttctaagtggcttttaggaggtgattaaatccttttatggttagaaaaagcaaaaaaggaattatcctgagattaacattgagatagaaataatttctcctagataaaatattttcaaacaaaacatttatgtaactgaggtcatggattattccagggatgcactgttaaaaatttctagaatctgactgacaacaatgcccattaattgctgtcctcccactcccttattctcagtgtgggacagtatattttctgtgattcacaaacaatgttatatttggtgctttgttcttcacggggttcatttatggaatattacatttaggacctttggacctaaatataactttatttgaacaaaatgaagtttctatttacctcaataagtaatgggtgtcatgactgtaagattttccatagtcctcaaatccattcagctaatcgatccttcagaaattgacattgtaattgtaaccgaaatcctatccatgtggtagacttgagatttcttagctgatgcacactgctctcggtactctatggctgaatataagcattatacatgtcctgtggtttatccttagattgtcatttaggagaaaggtctcaagctgggctgaatgctgtgcacgcatagtcccagctacttgggagtctgaggtgagaggattgcttgagccctggagttgaagcccagcctgggaaacatagcaagaccttatcactaataaataaataaacaaacaaacaaacaaacagataactaaaggtttcatggtataggaaaacacagatgcaaagtttgtgcctagttgctggtaatgttgcaaacataactccttagtgaactgtaccacttaaaaatagttaagatggtaaattttagaatatgtgtattttttaccataattaaaaaaaacctcctgtcttcctaaagttcagtgtaattgtcatatattcttttaaatttttactgtatctattttcaaggcataacattatggaaaatttgcaagaatagtacaatgaactcctatacttttcacctagattcaccaattgttaatagctttcgcttcataggtttcatatcacttccctctcttaccctgcttcccacacactcacacacacacacatacagatatatgtttactgttattaatgctgaattgtttcgataaattttcaggtgttatgaccctttacaccaagtacttgagggtgtgtacatcatcagaacaaagaaaaagtaattccttggtcatcactgcagaaaaatcaaaatcaggaaatttaacaatgagaaaatgcagtcatttattacacagtgtatactcaaatttcgccagttctccagacaatttcttttttcctttttttttttttcctttgttgagacggagtctctctctgttgcccaggttggagtgcagtagtgcaatcttggctcactgcaacctacacctcccaggttgaagggattctcttgcctcagcctcccatgtagctaggactacagggcctggccaccgtgcctgagtaatgtttccttttttttgtttgtttgtatttttagtagagatagggttcgccctgttgtccaggctggtcttgaacttctgacctcacctgatctgcccaccttggcatcccaaaatgtttggattacagttgtgatggaacaggaattaaaagaaattaaagaatgtgtaagcaaaaactcagttgtatgtaagaaaacccaatttcccctgaggaagagaaagagctggagtcctttaaaattaactgcctgtttttccttctgtggctagtgagtcttatctctccctttccgaggcattgtgaagaccctgtttctctagttgtgcagctgcaaggtcactagacagataatctcaagtggtaaaacatgttgttccttgaaaagtaagaaataatgtaatgcatgtttcaattgagtaactgtatttgtttcccacttctgtaatatgcttcccctgcacagatctccccctgccccacgaaatgcttaaaagatagcttgactctttgtttggggctcagtcctttggatgttaatctgactaggtcggtgcatctaaataattaaataattcctcctcaacccctcggtctctctgattccttaattatcctgcagcatttctggtgacccggacagggattggagatggcagatttactgtctcctttgtctgtgggactagagccccacggccaggggagacctggtatccaaggcgtgccgtaggggagcttcacctggatggagactggctctcccggcatcccagtggcctagctggctgcacaacggaactggagacggggctgcagcatgataccagcacttcaggtaccacagtaaggagaaagggcccaaggcaggaaagcccatcccatagggatgaaggggagcttgatcacctcccggggaccgaccactaatccaacccagagtggctggggggcagcaggagtggcctgccaatttggatgaacctcatgtccccctaataaagtgaaagtggctcagtggtggagaaaatgggccaatagagtggcaagtgcagcaaggaagagcttgctggcagggtgcaagagtggcttgccagcccaactgggagtgtgtgggtgtgtgtgtggacctacccaggacatgagagaggctcgtttcgtctgatgaggagtcctggggtaggagtggtgtgtaggtgtgtgaatgtgggagcctaactaggctcacccaggacacgggagaggcccgttttgtccgatgaggagtcctggggcaggggacatgtgtgaaagtgtgtgaaagagacggtctcgggagaggccaatgcggggagtgacgtggggaagcacagatcccttagcgtgggctgtgtgctctgaggcaagtgcgggggaaatcagacctaggacgttgtgtacagctgataggaccagctccatggccacagcaggctgtgagaggggaaggcacgttcctggctaagcagcctctgaaactcccataataggacccagtctagtggacccgagagtgaaagtgagagtgaaagtgcgccacaagggaggaaatgggaggaaaagtgttgaaaccaactcctttggagtgcatgatgaaaaaatttaaaaaaagatttagaggtgattatgggatgaaactggatgctcaaaagttaaggacatactgtgaattagaatagccctcttttagtgtcagatggcgggccgaaggcactacagagaaattggccatgtgttttaaggtggtgactagggtcagaggacagccagggcattcagacctagtctttacattgatgactaaatgaatgcagccctgcctagcagtttattgtagaatgctcgcagctcatgccaagagaaaccagctgctctgacggctacagagttaaagggaaagtcacagaggcttgtaactccaaaagtaaaaagtgaaaagtaaaagccaaaagtgaaagtaaaaatcagctgccctggcagctatggaaacaaaagaaaagtctgaggaaggagaaaactggttttgcaagaaccacaggagggaatagagacccctcctccctacattccaatctacccccctttactaaggctaactgcccctaaggagttaagttcaaagagatacaggctcccagtctcacagaaggagaaatcagagctccaggaagttaaagtgaaaagctagaaaagtcaggtaggccgtctcaggtctggccatgccgaagttatgcttacgcctcttacgaggacaaaaggacccccactaggacccagatgatgcagtctggcttcaacacctacgaaggtgccgagaaacacttctgcaaaagctaaaggatagtaaaagaaaaagacaaccaatataaaaaatctcagaggtgctccagggtgcagataaaagcaccagccagttttaagaaagactttgtgaggcattttgggtgtacactccgtttaaccccaaggctgctgaaaatcagtgcatggtgaatacaacatttgtaagtcagggccaaggagatattaggcataaattgcagaagttagaagctccgtaggtgtgaatgctactcagcttattaaagtggctaccaaggtgtacattaactgagatcaggaggcaaagaagaaagctgatcggaggcttaagaaaggctaatttactagcagcagcccttacaggaagagaagctggctctttgcaaggagacatggacgcgggtgtgaacgcagtcatggaaaaggctagtctggacaggagtttgaaagccggccgaggctagagagagattaatgtgcacggtgcaaaaggaaaggacactagaaggataaatgtcaaaagagtaaggagaatggtcaatggcctaacacccaagagcggcgttcggttgctagttgtggtgcttccgaggcagatcctgatctgatcggcttagcggggggccgagaatttagcagactgagacagaccgggctccatccttttaggccccggggagcctatggtctctatggaagtagggggccgatcaatggatttttttggtcgatattggtgctgatttctctgtggtaacccacccgattagcccccccccacaaagaactgtgctactatcgtagggggtacaggggccaaagaaaagagacccttttgcaaatccaggagatgtattattaggggacaagaagtgcagcatgagtttctatatatgccaaattgtcgagtgcccttgttaggaagagacttactccagaaactgcaggcacaaatttcctttacacctaaagggaatatgacactggagtttggaaagtctaaggcaatggtattgactctaactgtcacaaaggctgaggaatggcggctctgtgaactgtgtgccagaaggctaccggagccagacctacacaataagtggggaatgcttttcaaggaaccaggtgtataggctgaggacaacccccctggacttgctgcaaacagacccctggtggtagtagagcttaaccctcatgctgccctggtacgagtccgtcaatatccctacccagagaggcaattgatggcataacaaaacatttaaatcggctgtatgaacataggattatagtgaaatgcaagtccttctggaatactcctctgctgcctgtgcgcaagccaaatggtgaatacaggccagtttacaaagtgtccagggacaaggcaaaagtctgttttcgggaggttggatatctaggattcatggtatcccaaggccagcgcaggcttggaagtgcatgcaaggaggctgtatgtgcattgcccaccccagtttcaaggcagcaggtcaagaaatttctgggtgcagtgggattctgccgaatctggattccaaacttctcccttacagcaaggcccttatatgaggctaccaaaggaaaagaaagagagcccctcgtataggaaaaggaacagcaaaaggccttcaaagatataaaggaagctctcatccaagccctggcgctagggttgccagatgtaaaaagcccttcttttgatatgtggatgaacggaagggaatggcagctggagtcttcactcagttgttgggctcttgacattggccggtagcatacttatccaagcgactggacttggtggccttaggttggccccactgcctcagggcgctggcagctatggcaatccttatagaagatgccaacaagctagccctaggtcagaagacaatagtctgggtgccacacgctatagtcaccttaatggagcaaagaggacatcgttggctgtccaactctagaatgctaaagtatcaagggcttctgtgtgaaaatccccagataacactggaaactataaatacggcctgtggaggaccctgattggaatgatggtgggttgcctcactgctggcaggaccttccccactgttgcataaatacggtgaacgagccgggaagatctcagagataccaccttggagagcccagatgttgaatacttcactgatggtagcagtttcataacagatgaggtgtgatatgcagggtatgcagtagtgacccaatactcggtggttgaggctcaagccttaccttctgggacttctgcttagaaggctgaattaatagcattaaccagagcactgttattggccaaggggaagaaagtaaacatatgtaatgattcaagatatgcttttgcaaccctgcatgcccatggggcaatacacaaagagagaggactattggctactgaaggaaaagaaataaaaaataaagaggaaattttgcaattattagaagccatatgggctccagagaaggtggctgttattcattgcaaaggacaccaaatcgggaagagctatgaggtgcccagcaacagaaaggcagaccaagaggctaggcaggcagcaatgagaaaggctttacctgaagaaagaactctagcaatgcctctccttatagagccccctttattggaggtaaccaattactcttcaagggaaaaagcttggtttggtcaggaaacaggaaaatatattaaaaatggatggtggctgttctctgacgggaggctagctgtcccagaaacaaaagccccaaggtttgtgaagcagatccatcaaggaacacacattggaaggacgactagaaactttgataggtcggcatttctatgtgccacggctctctgccatcgcccatgctgtttttgaacaatgtctatcctgtgcccggaataatccaaaacaaggacctactcgacttcccggaattcaggaagcaggaactgttccttgtgagaacctgcttgtagagttcactgagttacctctagcaggaggttactggtatatgctagtgtttgtttacaccttctcagggtaggctgaggccttccccaccagaactgaaagggcacgagaggtgacaaaggtgctactaaaagacatcataccaagatttgggttgcctttaaccctaggatcagacagtggtcctgcatttgtggcagaagtagtacaaaagctgactcaacttttaaagatcaaatggaaactgcacacagcctactcaccacagagttcagggaaggtggaacggatgaaccggacactcaaacagctactaaaaaagtttagccaggaaactcacttacgatgggatcaggtcttgcccatggtcctcctccaggtcaggtgtacacctacaaaacaaactgggtactcaccctatgaaatattgttcggaaggccacccccaattattaatcaaattagaggggatttaaaggagttaggagagttaacccttaggagacagatgcaggctttaggagtgggaatgtaggaggtgcatagctgggtaagggaaaggatacctgtaagtctaacagacccagtgcatccacataagccagaggactctgtctgggttaaaaggtggaatccaacaaccttggggcccttatgggatgggccccatattgtgatcatgtctacttccactgctgttaaagttgcaggtgtcacaccttggattcaccatagccgcctgaaaccagtggcagcagtgactcccgacgatgaccagtggattagccaacaagacccagattgtcccacccgaatgctcctacggcaaaacccaaccaccggtaagaaggacgactgccctgctctgaccacaccagaggctggtcagtctacatatggctgaagcttgaggatcctacaagctctgctctagtcacatcctggaagctgactagtctatgcatggccgaagctaagaggaccatctccggataattaaatgtaaatacaatttataagcctagttataattctgtcaatactgattgttctgttgttattactgcaaatgctgcaaatgtctatgctcagaagaaggtttgccatgcccatgtgtagtgtaaacatgtttctattacgtacactgatgttgttaccatttctgcctatactaaaaggggagaaatcttgagaaggatgcccacattgtgtacacactacctgggtaaaaaataccatagttaaaattctactgtaccatacctactataaatgtacaggaatcaagttaagaacctacacatacaaccagaaacagtctgcaatggtttaacacaagagaggcttagcaggaccagccctaaacatctgtatggagaaccacaaatcagatgccctgactgtaacattcagtggtctacactaacacagctctaacacttatattcaggaaggactgctctgctaaggagtatgtcaaccaaaccaaattgtaagacaaggacatgcaatcctttaaattttactatcttaaagccagagctacctttctcgtctacaggacagacagcactattacaggtaaacagacaaggagcaggccttggagttccactactaattgtcaaaaagactagaaggactcaaatgcgtccaaccccgcaatttcgggtccgtaagtcattctataagcattttgttcagtcagtgcctgagcttcccccatcaaccaaaaacttatttgcccaatcagctgcaaacatagctggcagcttatgaatttcctcatgctatgtatgtggaggaaataatatgggggaccagtggccatgggaggcaaaggaattaatgccacaagataacttcactttgcctaaccctgccagtgaaccaacagcctcagccagtgtttggttgttaaaaacctccataattgaaaaatactgtattgcccgttggggaaaggctttcacagagagagtaggagaaacaacctgcctagggcaacagtattatgataagactaaaaacaaaactctatggagaaatgcccagaatgactcctacttaccagatccaaaccctttctctcggttctctactctaagccactcttggcatctctagaggctccaaatgcttggaaagcaccctctggcctatattggatctgtggcacataggcatattggcaactgctggctaaatggacaggggcgtgtgtgttaggaacaatcaagccatccttctttctaattcctctaaagcaaagggaactcttagggtatccagtttatgaggaaaataaaagaagaactagaagaagcatattcacaaaaatagacacaaatgtcaaaaaggatgtagacataggagactggaaggataatgaatggcctcatgaaacaatcactaaatattatgggccaactacctgggcacaggatgggtcatggggatatcacaccacaatctatatgctcaactgcgtcataaggttgcaggcagtccttgaaattataaccaatgaagcatcaagggcactagatttattggcaatacaagcaacacaaatgagaaatgctatacatcaaaatagattggctttagattacctcttagcctcagaaggaggagtatgtggaaaatttaatttaaccaactgttgcctagaaatcgatgataatggctgagctgtcatggaaatcacagctagaatgcgcaagttggcccatgttccagttcagacttggtccggatggtccttggatttgttgtttggaggatagttctcaacctttggaggattcaaaactctcattggtgggtttttgtttaatcttggcatctgcctcatcctcccttttattttacccctgattattaggagtattcagtcaactataaaggcaatagtaacccgacacactacctcacagttgatggcattaaccaaacatcagctgctgccagtagaagaagaagcccagctccacgaagaggtggcaaataatggtgcttgctatgaacacctttgttatgaaaagcaccaaaggggggaaatgaaacaggaattagaagaaattaaagaatgtgtaagcaaaaactcagttgtttgtaagaaaacccaactccccctgaggaagagaaagagctggagtcctttaaaattaactgcctgtttttccttctgtggctagtgagccttatctccccctttcccaggcattgtgaagactgtttctctagctgtgcagcagtaaggtcactagacagataatctcaagtcgcaaaacatgttgttccttgaaaagtaagaaatgatgtaatgcatgttttaattgaataactgcctttgtttcttgcttctgtaatacgcttcccctgcacagatctcacctgccccacgaaatgcttaaaaggtagcttcactctttgtttggggctcagtcctttggatgtaatccaactgggtcggtgcacctaaataattaaataattcctcctcaaccccttggtctctctgattccttaattatcccgcagaagtgagaccccacgcccaacgcagataattttattgatagaattcctttttctgatccggagtcaagttcaggatcacatcttgcatgtgcttttcaggtgtttttagtttcctttaatctggaatgtttccttaatttgtctttgtcattcatgatacagacatttttgaagaggatagaccagttggtttccagaatgttctgcagtttgggctttttcatgtcttttttaaagaccttttttaaactcagcatttattgctggctagtcatgccatataacagtctaagtgctaggagtgtaagtgctgtgagagacaggatttcagccttgaatcatttaatatgagaaggacaatcagaggtagaataacaaagtgcaaaggaggcagcagagttgtctgagggcagtctctggaaaggaagagggtaatatttggaacaccttgttttcctgttttctgctaacagactcctgaaataatgttcatgggattcttatcaacatatttattattatactagctaaagcttttatataataacaccgagagcatgaatattattttcttattcatatttcatgttttactgcttaaattgatatgtattttttatttttaatggccgaagcctgaagctgatagccaggaacaggttcacccaaagactgggtgtgagtgtggagatggtcctgatggccaggagatgggcctgccaaatccagaggaggtgaaaaggcctgaagaaggtagggaatccattaggcatgcacattgtagggtgtctgtttccacagtatcgtatcataattattattacatttttgagatggagtcttgctctgtccaccaggctggagtgcagtggtggcatctcggctcattggaaattccgccttctgggttcaagtgattctcctgtatgagcctctcgcggagctgggcttatggacatacaccaatgtgcccagctaatttttgtatttttagtagagacagggtttcattatgttgcacaggttgttcccgaactcctgacctcaggtgatccacttaacttaacctttgaaattgccaggattacatgcgagagccaccatacgcgaccaaggcattatatttttaataacacaggtaacaatactgcctctttagtaagagagttcttatatgaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgggacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgtcacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagacggtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagcc

SEQ ID NO: 2337 - DNA, 7352 bp, Homo sapiens
cgtcttctgcccggccccttcgcccacgtgaagaacgccagggagctgtgaggcagtgctgtgtggttcctgccgtccggactctttttcctctactgagattcatctggtaggtctgcaggccagtcatcccgggggctgaagtgtgagtgagggtggagagggccttgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagatggggtgagtgctgttggggggatggaagtcccgaggtgccgggaacccccgacgacacagggcagattccctgaatggggcctccggcgggggcgaggcgggcggtgaagaaggggcctggcacctgggaaggctgcggcctggtgagcgccccccccagcggtgtggagtgcggagcgcctgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacatgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctattattggcctagaccaagaccctatgtacagcctcctgaaatgattgggcctatgcgggtgagtgcttgaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacatactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatgcgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttattatttatttatttatttatttatttatttattgttatactttaagttttagggtacatgtgcacgttgtgcaggttagttacatatgtatacatgtgccatgctgttgcactgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctgcaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaaagaa

SEQ ID NO: 2338 - DNA, 6080 bp, Homo sapiens
tatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaa

SEQ ID NO: 2339 - DNA, 7306 bp, Homo sapiens
cgccttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtggaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatcttatgaaggaaacattgattctggaggatttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaacacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttaatagctttcgcttcatcggtttcacatctcttccctccgtctcttaccgtgctgcccacacactcacacacacacacacacacacacatacggatatatgtttacttttattaatggtgaattgtctcgataaagtttcagggattatggtcctttaccctatgtacttgagggtgtgtatatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttcctttgtttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcacaggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 2340 - DNA, 7288 bp, Homo sapiens
gagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 2341 - DNA, 7273 bp, Homo sapiens
acgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtctgttttcagtgtgaaatatgagttggcgaggaagatcgacctattatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcttttaggaggtgattaaatccttttatggttagaaaagcaaaaacggaattatcctgagattaacgtgagatggaaataatttctccgagataaaatgttttgaaaggaagcgtttatgtaatggaggtcatggattattccagggatgcactgttaaaagttcctagaatctgactgacaacaatgcccattaattgctgtccgcccactcccttattctcagtgcgggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccgtccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaatacataaatgaataaataaataaatacataaataaattcattaaataagtaaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacatagcattcatagaaaatttgcaagaatagtacaatgaactcatatactgttcatctggattcaccaattgttaatagctttcgcttcatcagtttcacatctcttccctccgtctcttaccgtgctgcccacacactcacacacacacacacacacatacatactgttattaatgctgaattgtctcgataaagtttcaggtattatggtcctttaccctatgtacttgagggtgtgtatatcgtcagaacaaagagaaagtcatttcttggatcatcactgcacaaagatgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacccacacctcccaggttctagggattctcatgcctcagcctcccgtgtagctgggactacaggcgccggccactgcgggcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattatgttagctaaagcttttatataataataccgagagcgtgaatattattttcttattcatacgttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccgggcttacaggcgggctccgccgcgcccagctaattgttgtatttttagtagagacagggtttcgttatgttgcacaggttgttcccaaactcctgacctcaggtgatccacctgcctcgaccattgaaattgccgggattacaggcgagagccaccgtgcccgacccagcattatatttttaataacagagaggtaacaatactgcgtctttagtaacagacttcttatataaaggttatttgaaacgtagttcaggccccagcacccgactgatagactgtcagatagggaaacaaactgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcaggaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatacttttagggtacatgtgcacgttgtgcaggttagttacatacgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctgcaaaggacatgaactcatcattttttagggctgcatagtattccatggtgtatatgtgtcacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacgcatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcaggggggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtaaaaagcaatcacagtgttaaaagaagacacgttgaaatgatgcaggctgctcctatgttggaaatttgttcattaaaattctcccaataaagctttacagccttctgcaa

SEQ ID NO: 2342 - DNA, 7292 bp, Homo sapiens
acgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaa

SEQ ID NO: 2343 - DNA, 7268 bp, Homo sapiens
gtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaaagaa

SEQ ID NO: 2344 - DNA, 7263 bp, Homo sapiens
tggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgatgacacagggcagattccctgaatggggcccccggcgggggcgaggcgggcggtgaagaaggggcctggcacctgggaaggctgcggcctggcgagcgccccccccagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgtgtcacttttctcacagtaacctccctgtggttggagtaaccttattgggcatagagcatagagttggagaaatgtctttaggcttagttatgaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcgtggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacagggttcatttatggaatattacctttaggaccttcggacctaaatataactttatttgaacaaagtgaagtttctctttaccccgataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacgtaacatttatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagttgaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaacgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatacacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttatgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctttacagccttctgcaa

SEQ ID NO: 2345 - DNA, 7291 bp, Homo sapiens
aacgccagggagctgtgaggcagtgctgtgtggttcctgccgtccggactctttttcctctattgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgacgggaacccccgacgacacagggcagattccctgaatggggtccccggcgggggcgaggcgggcggtgaagaaggggcctggcacctgggaaggctgcggcctggtgagcgcccccgcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtagtcccagttactcgggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttatcttgagagtattttcaaaagtaaaacggcaagtttacatttatccatggaagtgatcgaatatagcagccctgtggagcgcacgttcccaatcacggttgtgtgttttcagtgtgaaatatgagttggcgaggaagatcgacctatcggcctagaccaagacgctacgtagagcctcctgaaatgattgggcctatgcgggtgagtgcttaaacgttaattcgatgttttctattagtagaaattaatttttgtgatagcgttgttgcattagtgtggaaatgctgataaaggtctttcctgctcataaaaaatgatgatggcatctcatgaaggaaacattgattctggaggattttttttttcctctcgtgttcttcagcttttgcccatgacttctttctccggctttgtttgttaatgacagattgtacacatgtattccaacacagagtacaatagcctccaaagtcctcgtgcgtcacttttctcacagtaacctccctgtgggtggagtaaccttattgggcatagagcatagagttggagaaatgtctttaggcttagttatgaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcatgtgtgtgtgtgtgtgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtattgtgttccaaggtttgtgtcttcctatcatgtgtgttgctgtaaagaaggaagtgattttgctgaaaatgcttaaaactcaaaaggctttactgtaaggtagctcagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacactcacacacacatacggatatatgtttactgttattaatgctgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggttggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaggagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaactcttactatgtttttgagacggagtctcgctctgaagaccaggctggagtgcagtggtgccatctcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacagagaggtaacaatactgcgtctttagtaacagagttcttatataaaggttatttgaaatgtagttcaggccccagcacccggctgatagactgtcagatagggaaacaaagtgagtcaaagctatgttgaattaaaagttttgagtataaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagactttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtataagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttcttttttttccttttatttatttattatactttaagttttagggtacatgtgcacgttgtgcaggttagttacatacgtatacatgtgccatgcaggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcgatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaatctttccccacggaaaccttgagtgactgaaataaatatcaaatggcgagagaccgtttagttcctatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcagctttagagacatgaattgataagatttaaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaaggcacgttgaaatgatgcaggctgctcctatgttggaaatttgttcattaaaattctcccaataaagctt

SEQ ID NO: 2346 - DNA, 9528 bp, Homo sapiens
cactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgttaggcattgtcacataggaggaagaggaggaaagaaaacaatggaaagaatgcctgaaattgactggaaaagcgaggaggctatgtagttcgcagcttagcttaggcaaatccctcactatggtaaaagatctcgactttatgaatgagagaatggaggtgccaggattgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctcccagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagattttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcatcgctaataaataaataaatggataaataaatacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttgtaccacaattggaaattcctttcttcctaaagttcagtgcagttatcatatattcttttaaatttttcctgtatgtatcttcaagtcatagcattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacatacggatatatgtttactgttattaatgctgaattgtttcgataaagtttcaggtattatggtcctttaccctatgtacttgagggtgtgtttatcgtcagaacaaagagaaagtcatttcttggatcatcactgcacaaagatcaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacccacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtaatatttggaacaccttgttttcctgttttctgctaacggactcctgaaataatgttcctgggattcttatcaacacatttattattacgttagctaaagcttttatataataataccgagagcatgaatatcattttcttattcatattttatgttttactgcttaaattgatacgtattttttatttttaagggccgaagcctgaagctgatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaagtcttactatgtttttgagacggagtctcgctctgaagaccaggctggagtgcagtggtgccatctcggctcactggaaattctgtctccagggttcaagtgattctcctgcctgagcctctggcggagccggggttacaggcgtgctccgccgtgcccagctaattgttgtatttttagtagagacagggtttcgttatgttgcacaggttgttcccgaactcctgacctcaggtgatccacctgcctcgaccattgaaattgccgggattacaggcgagagccactgtgccagacccagcattatatttttagtaagagagagttaacaatactgcctctttagtaaagagttcttatataaaggttatttgaaatgtagttcaggccccagcacccgagtgatagactttcagatagggaaacaagctgagtcaaaggtatgttgaattaaaagttttgagtataaatcctcaaaccagtagctcataattttcaaatgcttttgcaaaggtctgcttttaatcaatacataacacatttgtaacacccatcacttggtgtgaaaaatgctgaagcactcatgcgggttctaatatcagctcttacagccttggtgagattctgagtgagtcctttcacttctaaacctatctttggttgttatgaaaatagtgagtttaagtcagagattttaaaaccattttccattccggttctttcatactctgatcctgttgcatagaatgcgtgggacacagagatcatctgcttcgcatggtttgttaatcacaaatcatgaaaccctggcccgagtcatctgaaaatctctgaattgagatttcattgttagtaagaaagtgagggggcactctgcttcatcctagtttttccgtgtggagagctgaatacgtagtgtaagatcttgtgaaattgtgaattctccctcttcttggtttgtttgtttgtttgcgacggagtctcagtctgtcacccagggtggagtgcagtggtgtactttcagctcactgcaacctctggctcccaggctaaagcagtcctcccacctcagcctcctgagtggctggaactacatgcacaagccaacgtacctgagtaaaattttttttttcatttttgtagagatgaggtctcactatgttgcccagactgggattctctggcttttaatgaacaattgcttcttaaatctttccccacggaaaccttgagtgactgaaatatcaaatggcaagagaccgtttagttcctatcatctgtggcatgtaagtcagtgatgctcagcatgggtgtgagtaagatgcctgtgctatgcatgctccctgccccactgtcagtcttgatgagccactatttctaataagactgtagacacacatatgatataatcatctctaatcatatcaaatgttacatgtaaatttcagctttagagacatgaattgataagatttaaagttgaaagaccatgactctagtccttcctgagtaatcaactgaagtatatttcacacatgtgttttccaaattgctgactgttaattgtaattgcttgtgacttgaaaggaagcacttgatgtttagggaagaaattacctttaaattctggagggctactctcaaagtgtattccgagattcaattggatatacgacagaggatcaccttagcgttctgtttttagtccatttaataaaacccaaactgtagtgtgctttgtatgcctttagggccatctaaataatctgttgctcagccgggcgctgtggctcacgcctgtaatcccagcactttggaggccaaggcgggtggatcatgaggtcaggaattgtataccatcgtggctaacacggtgaaaccccgtgtctactaaacatacaaaaaattagcccttgtggtggcacgcgcctgtggtcccagttactcaggagtctgaggcaggagaatcgcttgaacccagaaggcggacgttgcagtgaaccagattgctccactgtactccagcctgggcaacagagtgagactccatctaaaataataataataataataataataataataataataataataatctgttgctctgtaatgttcccaactgttttgttttgtttcaggtgaagggcaatcacagtgttaaaagaagacatgctgaaatgttgcaggctgctcctatgttggaaaattcttcattgaagttctcccaataaagctttacagccttctgcaaagaagtcttgtgaatcttttgtcaattttatttctagctatttgatgctgtgaaatgtttcattctttgaaattttgttttctatctccttgagctgtgtgtagaggcataattctcatgtattgattttctatccagcaaccttgttaaatatgcttatgaattttaaaagtttacttctaggttttttcaattttcaacctacagaatcataccatttttgaataagaacaattttgtttctgccttttttgtttgttttttcttttgtatttttcgtagaggtgggattttggcctgtgtcctaggctttttttgaactcctgagcgcaagtaatccactctccttggcctttcaaagtgttgggattacaggcatgggccaccgtgctggtcctgtttttgccattttaaacccttttatttccttttctgattttatggcattgagcagatctaccggatacaattgtgatagtggaaatttttgtgttattcctgatgagaaatggaaaaatttcaacatttcacgacaatatttagtgtactttttttgtagatggactttttcagagtaagtcaagccattctgttttagtttgttgagagtgttcattttgaatatatgttgaatttcatcaaacactgacctgagtcatcttaaaacatgtgaattgagatttctttgctactaagaaagtgagcgggcactctgcttcatgtttacttttgtcatgttgcatgaaaaacattttgcttcatgtttgattctgtatgttgaaaactgaaatcatctattgtgattaccacagggttttttcccccagtaatctgtttatgtagtcaattacgttgataaatctgtactttttaaattttaacaattgagacaggtctcactctgtcacccatgctgactgcagtagtgtgatcacagcttactgcaacctcaacctcctgggctcaggcgatcctcccacctcaccctcctcagtagctaggactataggtacatgccaccatgccaagctaatttttctgttttagagatggtattttttcatgttgcccaggctggttttatactcctaatctcaagccatccactagcctcagcctcccaaagtgctgggattacaggaatgagtcacggtgcctggaaattttgtacatttaaaccaacaatttggtcatgggtaatctatgtcctaataatttatttaaggatttttatgtatatcctcatgagtgacattacctgtacttttatttcatatgctcatttgttggacgttgttatcaaggttcctctagcttcataaaacgggttggtatgtaaaacctctttttccattcactggaactcaagtctcctcaaggctgtgagtaatgcagggctaggctttcccataatgagcttttctagaatgcttctctcagatttggaccctacttaaacagcagtgaccaaacgggcagctccaggtacctatcccctcaaactttgtgagggtcgcgttctctgaagatgcctcttcaatttgaaagctatctgttcctgtttctctgctgatattaactctctgtgcacagaaagttaaacgtcactggttattaatttccctagattttgatctgtgctgtgtggctgagaatgggctgactgaccctagatctgtgtataattatgacaatggctctatttatttttaaaataagaggaattattataaaattcctatttactggatgtgtactatctatgaattacttctttgtgctaggttgtgtacatgtatgacctctttagatcctcacaagataaggcagaattttcatgaaattgatgactgactccagtaagaagcagatttggggggatttcaatttctaagctcaaagcccttgcacttttctcaaagtaaagcttttgaaagtgttaaatgtacacgaactgatggtgtatatgatgattttagttgtaatctgatgttttctttaaaaatttacatatacaaaagtgtttgactcaaaaggctttgttcttcccttaaaggaagcatctaccaaaatgtggcacacaaaccttgcatggtgtctctagggcctcctaccccgcatttcccctgctttttctcttgttctgactgaaaaacaaagtgctttgactgtgctgtgacccagccagctgcatgtttacccagcatgcttgaacccaagctggagccttgaacataaaggtgtttaagttgttgctcaaaatatggaaagaatctagctctggccttgaaccaaatcccttaaactctcctataaaactccataacctgaccccctcagtgcggatatacctaggcatgacattcttgttgcctgttgcgaggatgctttagcctactctaagttctcccaataaatgctttggactgat

SEQ ID NO: 2347 - DNA, 7366 bp, Homo sapiens
cgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2348 - DNA, 7378 bp, Homo sapiens
tgttcactgggcgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaatgtcaggatcctgcagctgctcagaagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccagggttgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagccggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttattatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacgcatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaagtcttgcgca

SEQ ID NO: 2349 - DNA, 7366 bp, Homo sapiens
cgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagtgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttgtaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatcacccatagggttctgtttttagtccatttaataaaacccaaagtgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2350 - DNA, 7368 bp, Homo sapiens
cgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgttaggcattgtcacataggaggaagaggaggaaagaaaacaatggaaagaatgcctgaaattgactggaaaagcgaggaggctatgtagttcgcagcttagcttaggcaaatccctcactatggtaaaagatctcgactttatgaatgagagaatggaggtgccaggattgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2351 - DNA, 7362 bp, Homo sapiens
cgtcttctgcccggccccttcgcccacgtgaagaacgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaagcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagggggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcctgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctcccagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagtttatgcagaggttcaattgcgtgtaagacacgggatcacccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaaagaa

SEQ ID NO: 2352 - DNA, 7329 bp, Homo sapiens
cgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagcgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttttatttgcacacccacacgtattccccagcccgagcagttcagtgatgaagtggaaccagcaacacctgaagaaggggaaccagcaactcaacgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgtgcacgtgtgtgtgtgtgtgttaggcattgtcacataggaggaagaggaggaaagaaaacaatggaaagaatgcctgaaattgactggaaaagcgaggaggctatgtagttcgcagcttagcttaggcaaatccctcactatggtaaaagatctcgactttatgaatgagagaatggaggtgccaggattgtgtgttatccaagaacccttgactggtgaatacaacatttgtactgtgttccaaggtttgtgtcttcctatcatgtatgttgctgtaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttattattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttttaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacagcagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatctcccatagggttctgtttttagtccatttaataaaacccaaactgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgctcctatgttggaaatttgttcattaaaattctcccaataaagctttacagccttctgcaa

SEQ ID NO: 2353 - DNA, 9528 bp, Homo sapiens; identical to SEQ ID NO: 2346

SEQ ID NO: 2354 - DNA, 7267 bp, Homo sapiens
cgccagggagctgtgaggcagtgctgtgtggttcctgccgtccggactctttttcctctactgagattcatctggtaggtgtgcaggccagtcatcccgggggctgaagtgtgagtgagggtggagagggcctcgggtgggtcaggcgggtcccgcttcctggtctgtggcctccgagggagaagggccacgaggtcgtcctccttcccttcacaggctgcgaggccaccggcggcttcgtggtcgtgaaggggcctggacggggaggaaggtgggccgtggaggggaggcggtcaggggctcaggtgaagacggggtgagtgctgttggggggatggaagtcccgaggtgccgggatccccgacgacacagggcagattccctgaatggggcccccggcgggggcgaggcgggcggtgaagaaggggcctggcacctgggaaggctgcggcctggcgagtgccccctcagcggtgtggagtgcggagcgcccgagtgagaagcactgcaaggtctcacctccgccatggaaggtccgaaaacagtgggaaggagtgggcgaggcagtgcggtccaaccaaacttgttgtgagtgggggtgaatggctctaggaagtgggagtgtgcccaaagcagcaatcacgagaattgtgattcactagggttttcgtggggagtgcacttgtgaaactaaacctcatcagaaatgacctctgtctgcggggcgcagtggcgctcgcctacgtattcccagttactggggacactgaggtgggaggatcccttgagcgggaggtcgaggctgcagtgagctgtgatcacgccgctgcactccagcctgagcaacacagcgagaccgcgtgtccaaaagaaatttagaaaaaaatgtcctctgccttttgccacacgccttaagatgattgctctgccagcctggccagcagaagtggctttgtaggcactcagacagcgtacacacgtatgcttaactctgggacttattttgagagtattttcaaaagtaaaacggcaagttaacatttatccatggaagtgatcgaatatagcagccctctggagcgcacgttcccaatcacggttgtctgttttcagtgtgaaatatgagttggcgaggaagatcgacctattattggcctagaccaaggcgctatgtacagcctcctgaaatgattgggcctatgcgggtgagtgcttaaacgttaattcgatgttttctattagtagaaattaatttttgtgatagcgtcgttgcattagtgtggaaatgctgataaaggtctttcctgctcataaaaaatgaggatggcatctcatgaaggaaacattgattctggaggattttttttttcctctcgtgttcttcagcttttgcccatgacttctttctccggctttgtttgttaatgacagattgtacacatgtattccaacacagagtataatagcccccaaagtcctcgtgcgtcacttttctcacagtaacctccctgtgggtggagtaaccttattgggcatagagcatagagttggagaaatgtctttaggcttagttaggaccagaaatagctatgtattctgtgtatatatgtaaaattttgtatcaataacgaaacttattttctatttgcacacccacacgtattccccagcccgagcagttcagtgatgaagtggaaccagcaacacctgaagaaggggaaccagcaactcaatgtcaggatcctgcagctgctcaggagggagaggatgagggagcatctgcaggtcaaggtgagggaaagggaagaagaacgtctgctggtgtgtgcgtgtgtgtgtgttcgtgtgtgtgtgtgcacgtgtgtgtgtgttaggcattgtcacataggaggaagaggaggaaagaaaacaatggaaagaatgcctgaaattgactggaaaagcgaggaggctatgtagtttgcagcttagcttaggcaaatccctcactatgataaaagttctcgactttatgaatgagagaatggaggtgccaggattgtgtgttatccaagaacccttgactggtgaatacaacatttgtactgtgttctaaggtttgtgtcttcctatcatgtatgttgctggaaagaaggaagtgattttgctgaaaatgcttaaaactcaaaaggctttactgtaaggtagcttagtactgacccaagaatagacccagttcagaggagcaggagcagctccaaaaaccgagtcgctgaatgttggcccccgtttcctttgattgatatttttatatggtacgtttgataaaagctggataaatgaggatactgccatacaggtagctggtttagtgatttttctcagcggcctttaggaggtgattaaatccttttatggttagaaaagcaaaaacggaattatcctgagattaacgtgagatggaaataatttctccgagataaaatgttttgaaaggaagcatttatgtaacggaggtcatggattattccagggatgcactgttaaaagttcctagaatctgactgacaacaatgcccattaattgctgtccgcccactcccttattctcagtgcgggggacagtatattttctgtgattcacaaacaatgttatatttggtgctttgttcttcacggggttcatttatggaatattacctttaggaccttcggacctaaatataactttatttgaacaaagtgaagtttctctttaccccaataggtaatgggtgtcgtgactgtaagatttccatagtcctcaaatccatccagctaatcaatccttcagaaactgacattgtaattgtaactgaaatcctacccacgtggtagacttcagatttctcagctgacgcacactgctgttggtactctagggctgaatataagcattatacatgtcctgtggtttatccttagattgtcatttaggagaaaggtctaaagctgggctgaatgccatgcactcatagtcccagctacttgggaggccgaggtgagaggattgcttgagtcctggagttcaagcccagcctgggaaacacagtgagacctcattgctaataaataaataaatgaataaataaataaacacataaataaattcattaaataaataaagttttcatggtataggaaaacacagatgcaaagtttttgtgcctagtggctggtaatgttgcaaacgtaactccttagtgaactgtaccacttaaaaatagttaagatggtaaattttaggatatctgtattttttaccacaattggaaattcctttcttcctaaagttcagtgcagttatcatatattcttttaaatttttactgtatgtatcttcaagacataacattcatagaaaatttgcaagaatagtacaatgaactcatatactgttcatctggattcaccaattgttagtagctttcgcttcataggtttcacatctcttccctccgtctcttaccgtgctgcccacacactcacacacacacacacacacacacatacggatatatgtttactgttattaatggtgaattgtctcgataaagtttcagggattatggtcctttaccctatgtacttgagggtgtgtatatcgtcagaacaaagagaaagtcatttcttggatcatcactgcacaaagataaaaatcaggaaatttaacaatgagaaaatggagtcatttaatacagagtgcatactcaaattttgccagttccccagaaaatttcttttttccttttttttttctttgttgagacggagtctctctctgtgggccaggtgggagtgcagtagtgcgatctcggctcactgcaacctacacctcccaggttctagggattctcatgcctcagcctcccgtgtagctgggactacaggcgccggccactgcggtcttgaacttctggcctcacctgctctgcccaccttggcatcccaaaatgtttggattgcaggcgtgagaccccacgcccggcccagataattttattgataggatttctttttctgatccagagtccagttcagaatcacaccttgcatgtgcttttcaggtgtttttagtttcctttaacctgtaatgtttccttaatttttcttgtcattcacgatacggacatttttggagaggatagaccagttggtttgcagaatattctgcagtttgggctttttcatgtatttttaaaagagttttctcactcagcgtttattggtggctactcatgccatgtaagagtctaagcgctaggagtgtaagtgctgtgagagacgggatttgagccttgagtcatttaatacgagaaggacaatcagaagtagaataagagagaagtgcaaaggaggcagcaaagttgtctgagggcagtcttcggaaaggaagagggtattatttggaacaccttgttttcctgttttctgctaatggactcctgaaataatgttcctgggattcttatcaacacatttagtattacgttagctaaagcttttatataataataccgagagcatgaatattattttcttattcatactttatgttttactgcttaaattgatacgtattttttatttttaagggccgaagcctgaagctcatagccaggaacagggtcacccacagactgggtgtgagtgtgaagatggtcctgatgggcaggagatggacccgccaaatccagaggaggtgaaaacgcctgaagaaggtaggcaatccattaggcatgcacattgtagggtgtctgtttccacagtatcatattgtaattgttactatgtttttgagacggagtctcgctctgaagaccaggctggagtgcagtggtgccatttcggctcactggaaattctgtctccagggttcaagtgattctcctgcctgagcctctggcggagccgggcttacaggcatgctccgccgcgcccagctaattgttgtatttttagtagagacagggtttcgttatgttgcacaggttgttcccgaactcctgacctcaggtgatccacctgcctcgaccattgaaattgccgggattacaggcgagagccaccgtgcccgacccagcattatatttgtaataacggagaggtaacaatactgcctctttagtaacagagttcttatataaaggttatttgaaacgtagttcaggccccagcacccgactgatagactgtcaggtagggaaacaaactgagtcaaagctatgttgaattaaaagttttgagtgtaaatccttaaaccagtagctcacaattttcagatgcttttgtaaaggtctgcttttaatcaatacataacacgtttgtaacacccatcacttggtgtgaaaaatgctgaagcactcatgcgggttctaataccagctcttacagccttggcgagattctgagtgagtcctttcccttctaaacctatctttggttcttatgaaaatagtgagtttaagtcagagattttaaaaccattttgcattccgtttctttcatactctgatcctgttgcatagaatgcgtgggacacagagatcatctgcttcgcatggtttgttaatcacaaatcatgaaaccctggcccgagtcatctgaaaatctctgaattgagatttcattgtcagtaagacagtgagcgggccctctgcttcatcctagtttttccgtgtggagagctgaatacgtagtgtaagatcttgtgaaattgtgaattctccctcttcttggtttgtttgtttgtttgcgacagagtctcagtgtgtcacccaggctggagtgcagtgatgcaatttcagctcactgcaacttctggctcccaggctaaagccgtcctcccacctcagcctcccgagtggctggaactacatgcacaagccaccgtgcctgactacatttttttgttttcatttttgtagagatgaggtctcactgtgttgcccaggcagggtttctctggcttttaatgaacaattgcttctttttttttcttttatttatttatttatttatttatttatttatttatttatttatcattatactttaagttttagggtacatgtgcacgttgtgcaggttagttacatatgtatacatgtgccatgctggtgcgctgcacccactatctcatcatctagcattaggtacatctcccagtgctatccctcccccctccccccacccgacaacagtccccagggtgtgatattccccttcctctgtccatgtgatctcattgttcagttcccacctatgagtgagaatatgcggtgtttggttttttgttcttgcaatagtttactgagaatgatgatttccagtttcatccatgtccctacaaaggacatgaactcatcattttttagggctgcatagtattccatggtgtatatgtgccacattttcttaatccagtctatcgttgttggacatttgggttggttccaagtctttgctatcgtgaataatgccgcaataaacatacgtgtgcatgtgtctttatagcagcatgatttatagtcctttgggtatatacccagtaatgggatggctgggtcaaatggtacaattgcttcttaaaactttccccacggaaaccttgagtgactgaaataaatatcaaatggcgagagaccgtttagttcgtatcatctgtggcatgtaggtcagtgatgctcagcatgggtgtgagtaagatgcctgtgctatgcatgctccctgccccactgtcagtcttcatgagccactatttctaataagactgtagacacacatacgatataatcatctctaatcatatcaaatgttacatgtaagtttcacctttagagacatgaattgataagatttgaagttgaaagaccatgactctagtacttcctgagtaatcaactgaagtatgctttacacatgtgttttccaaattgctgactgttaattgtaagtgcttgtgacttgaaaggaagcacttgatgttcagggaggaaattccttttaaattctgcaggtctacgctcaaagttaatgcagaggttcaattgcgtgtaagacacgggatcacccatagggttctgtttttagtccatttaataaaacccaaagtgtagtgtgctttgtatgcctttagggtcatctgaataatctgttgctaagtcatgttcccaatcgttgtgtttctgttacaggtgaaaagcaatcacagtgttaaaagaagacacgttgaaatgatgcaggctgc

SEQ ID NO: 2355 - DNA, 8301 bp, Homo sapiens
tttgcagaaggctgtaaagctttattgggagaattttaatggtcaaatttccaacacaggagcagcctgaaccatttcagcgtgtcttcttttaaggctgtgattgcccttcatctgtaacagaaacataactgttaggaagatgatttagcagcagattatttagatgacccaaaaggcacacaaaggacactacaatttgggttttataaaatggactaaaaatagaactctaagggcgatcctgtgtcttatagccaagtaaacctctgtataaattttgagggtagacctgtagaatttaaaggtaattaattccgtaaacatcaggtgcttcctttaaatccagaagcacttataattaacagtcagcaacttggaaaacacatgtgtaaaacatacttcggtggattactcagaaagtactggagtcatggtctttgaacttcaaatcttaccaactgatgcctcaaaatctgaaacctacatgcaacatttgatatggttagagatcatgtatgtgtctacagtcttattagaaatagtggctcatgaagactgacagtggggcagggagtgtgcgtagcacaggcatcttactcacacccatgctgagcatcactgacctacatcccacagaaaatagaaactaaatggtctctcaccatttgattattcactcactcaaggtttccttggagaaagatttaaaaagcacttattcattaagggccagagaatcccagcctgggcaacacagtgagacctcatctgtataaaaaaaattttttaacaaaacaacatcagtcaggcatggcagcttgtgcctgtagttccagctgctcaggaggctaagttgggaggatcacttgagcctgggaggctgaggttgcagtgagctgaaatcgcaccacagcaccccagtctgggtgacagagtgagacttgtcactctgtcagagcgacaattcaaaaattgacagtacctaagaataggcattcaggtctccacacagaaaaactaacatgaagcagagtgcccgctccctttcttagtagcaatgaaatctcaattcagaggttttcagatgactcaggccagggtttcatgatttatgataaataaatcatgtaaaacagatgatctctgtatcctatgcattctatgcaacaggatcagagtatgaaagaaccagaatggaaaaggattttaaaatatctgacttaaactcactatttttataagaccaaagataggtttagaaggtaagggatttgctcagaatctcaccaatgctgtaagagctggtattagaacctgcatccgtgcttcagcatatttcacaccaactgatgggtgttacaaatgtgttatgtatttattaaaagcagacctttacaaaagcatctgaaaatcatgagctattggtttaaggatttatactcaaaagttataattcaatatggctttgtctcagtttgtttctgtatctgacagtctataagttggctgctgggacctgaactacatttcaaataacctttatataagaattctattattaaggaggcagtattgttacccctgtgttattaaaaacataatactgggtcaggtgcagtggctcatgcctgtaatcctggcactttagtaggctgaggtgggtggatcacctgagatcaggagtttgagaccagcttatgcaaaatggcaaaacctcgtctctactaaaaatacaaaaattagctgggcgtggtggagcacgcctgtaatcccagctacttgggaggctgagggaggagaatcacttgaacttgggaggcagaagctccagtgagccgagatggcaccactgcactccagcctggttgacagagcgagactctgtctcaaaaaaataataattattataatatgatactgtggaaacagacaccctacaatttgcatgcctaatggattgcctaccttcctcaggtgttttcacctcctctggatttggcaggcccaactcctggacatcaggaccatctccgcgctcacacccagtcttcgggtgaacctgttcctggctatccgcttcaggctctggcccttaaaaaaaaaaaaaaaaaaaaaaaaaaatatatatatatatacatatacatatatatatacatatacatatatatgtgtgtgtatatatatatatacatatacatatatgtgtgtatatatatacacatatatatgtgtatatatgtatatatgtatatatacacacatatatgtatatgtgtatatatacatatatatgtgtgtatatatacacacatatatatgtgtatatatatgtgtgtatatacacacatatatatgtgtatatatgtgtatatatgtgtatatatacacatatatatgtgtatatatacacatatatatgtgtatatatacacatatatatgtgtatatatataatcaatttaagcagtaaaacatgaaatatgaacaagaaaataatattcatgctctcagtgttattaaataaaagctttcactagtgtaataataaatgtgttgataagaatcccaagaacatgatttcaggagtctgttggcagaaaacaggaaaacagggttttccaaatattaccctcttcctttccgaagactgccctcagacaactttgttgctgcctttgcacttctttattattctacttctgattgtccttatcatattaaatgactcaagactgaaaccctgtctctcacagcacttacactcctggcacttagactcctacatggcatgagtagccaccaataaacgctgagtgaaaaaagttctttaaaaaatacatgaaaaatccccaaatcctgaacattctgcacaccaacttgtctatcctcttcaaaaatgtccgtatcctgaatgacaaagaaaaattaaggaaacattccagattaaaggaaactagaaacacatgacaagcacatgtaagacgtgatcttgaactggactctggatcagaaaaagaaattctataaaggaaattatctgggccaggcatggtggctcacacctttaatgccaacattttgggatgccaaggtgggcagatcacttgaggtcgggagttcaagaccagcctggctaatgtggtgaaatcccgtctctactaaaatacaaaaaaaaaaaaaaaagaaacatttatttgtcaggcactgtggcagggctgtaacctcaggactttgggaggctaagctgggtggatcatctgaggtcaggagttcgacacctgcctgtgcaacatgacaaaaccccgtctctactaaaattacaaaaattaggtgcctgtggtggcatacgcctgtaatcctagctgctcgggaggctgaggcaggagaatcacttaaacccagcaggtggatgttgcagtgagccaagattgagccactgcactccagcctgggtgacagagtgagactccatctcagaaaaaaaagaaaattataatactgtggaaacagacaccctacaatttgcatgcttaatggactacctaccttctgcgggcagtttcatctgctcttcatttcgcaggcacaccctcttggtatcaggaccatctccaagctcacacccagtctttggctgaaccagttcctggctatcagcttcaggctcctgcccttaaagataaaacaaaattatcattttaagcagcaacacatgaaatatgaataagaaaataatattcatgctcttggtcttattaaataaaagctttaggtactgtaataataaatgtgttgataagaatcccaagaacattatttcaggagtctgttggcagaagacaggaaaacagggttttccaaatattaccctcttcctttctgaagactgccctcagacaactttgttgcctcctttgcacttatctgttattgtatttctgattgtccttattatattaaatgactcaaggctgacatcctgtctctcattagcatttagactcctagcacctagcaagttatatggcatgagtaggcaccaataaatggtgagtgaaaaaacagtctttagaaactacacaaaaaagcccaaagtgctaaacgttccgcaaaccaactggtctatcctcttgaaaaatgtcagtatcagccagccgggcgtggtggctcacacctggaatcccagcactttgggagaccgaggtgggcggatcatctgaggtcaggagttagagaccagcctggccaacatggtgaaacccaggctctgctaaaaatacaaaagaaaaaataaattaggcaggtgcggtggccattgcctgtagtcccaactactcaggaggctgaggcatgagaatctcttgagcctgggaggcagagtttagagagagccgagatcttgccactgcactccaacctgggcaacagagtgagactccgtctgaaaaaaaaaaataagaaagaaaaaagaaaattatctggataactggcaaaatctgagtatactctgtgtattaaatgactgcaggttctcattgttaaatgtcctgagtttgatcattgtgcagtgattatccaaggaatgactttttctttgttctgaggatatataaacactttcaagtacttagggtaaagggccataatagctgaaaccttatctgaacaatgcagcattaataagagtaaacataatatccgtaagtgtgtgtgtgagtgtgtgggcagcagggtaagagagggagggaagagacatgaaaacaatggagcagaagctattaacaattggtgaatctaggtgaaaagtatatgagttcattgtactattcttgcaaattttctacaaatgttatgtcttgaaaatatataaagtaaaaacttgtaagaatatatgacaactacactgaactttaggaagacagaagttttttttttaattgtgttaaaaaatacacataacataaaatttaccatggtaactaattttaagtgttatagttcagtaaggagttatggttgcaacattaccagcagctaagaacaaactttacatgtttgttttcctatataacgaaacatttattatttatttatttatttatttgcgatgaggtctccctatgtttcccaggctggtcttgaaccctaggctcaagcgatcctctcacctcagcctcccaagtagctgggactatgatttcacagcactaagcccagtttgagacctttctactaaatgacaatctaaggataaaccacaggacatgtataatacttatattcggccatagagtaccaacagcagtgtgcatcagctgagaaatctgaagtctacatcatggataggatttcagttacaattacagtgtcagtttctgaaggattgagcagctggatggatttgaggactatggaaaatcttacagtcacgacacccattgtctactggggtaaacagaaacttaactttgttcaaataaagttatatttaggtccaaaggtcctaaatgtaatattccataaatgaaccccatgtagaacaaagcaccaaaaataacactatttgtgaattacagcaaatatactgtctcacgctgagaacaaaggaatgagtggacagcaattaatgggcattgttgtcagtcttattctagatacctttaacagtgaatccttagaataatccatgacctgagttagataattgttttgcttcaaaatattttatctcggagaaattatttccatctcatgttaatctcaggataattccttttttttggtttttctaaccataaaaggatttaatcacctcctaaaagccacttaaaaaatcatactacaccagctacctgtatggcagtatcctgaattctccagctttcaacaaacttaccacataaaaatatcaaaggaaatggtggccagcaatcaggaactcagtttttggagttgctcctgctcctctgaactgggtctattcctgggccagtactaagctacattacagtaaagcatttgagttttaagcactttcagcaaaatcatttactattgttacagcaacatagatggtaggaagacacaaactttggaacaaaacacaaattttgtattcaccagtcaagtgttcttggacaaaacacaatccccgggcctccattctctcattcataaagtggagaaattttatcatagtgagggatttatttccctaaggtaagctgcaaactataccctcttcacttttccagtcaatttctaggcatcgtttgcatggctttcattcctcctgttcctggtatgtgacaatgcatgagacacacacacacacacacacacacacacacacacacacacacacacacaccccaacaggcattcttcttccctttcccttcaccttgagctgcagatgctccctcatcctctctctcttcagcaggtgtagaatcctgactttgagttggtgattccacttcgtcaggttgctcatcactggactccttgtggtagggaatatgtgtgtgagtgtgcaaagacaaaaagttttgttattaatacatgtcaaaaaatatatacgtatacacacagagaatgcatagatgtttctgatcataactaaacctaaaaatatttctccaactttattctatatggttaataaggctactctacccacagaaaggttactgcgagaaaagttacccacaaggactttggaagctattgcactctatgttggaatagatgtgtataatctatgtgtcattcacaagcaaagcatgagaaagaagtcatggccaaaagttggagaacacaagagaaaaaaaaaatcctcctgaatcaatatttccttcatgagataccagaatcttatttttttaatcagcatgaactacctttattagtgtatctatactaatgcaacaacactatcacaaaaattaatttctgctaatagaaaacatcgaattaacgttaaagcactcaacagcataggcccaattacctcagaagattctacatagatcattggtctacgccgatagattaatcttcttagaaaacccatatttcacactgaaaagagaaaattgtgattgggaacatgcacttgagaggacagctatattcgatcacttccatggctaaatgttaacttgtcattttaattttgaaaatactctcaaaataagtcccagagttaagtgcaagtgtgtacgttttctgagtgcttgcaaagccacttatgctccccaagctggcagagtagtcatcttaaggcatgtggcaaaaggcagaggacattattttaaaatttcttttagacacagaatctcgctctgttgctcacgctggaatgcagtggcgtgatcacacttcactgcagcctcgacctcccgctcacgcgatcctcctgcctcgtccggagtagctgggactacaggcgcgcaccactgcgcccctctgacagaggacgtttctgatgaggtttagtttcacaagcggactccacatgaaaacactagtgaatcacaattcccgtgactgctgcttttggcacactcccacttactagagccattcacccccctcaaatcaagtttggttgggccacacagcctctcccagtccttcccattgtttccggaccttctatggcagaggtgagaccttgccacgcttctcactcgggtgtttctcactcgggcactccccactccacaccgctggggggcgctcaccagcccacagccttcccaggttccaggccccttctttaccgccatcttcaccacccacctcccgcctcggggccccattcaggactcaggaatgtgccctgtgtcatgggttcctaccacctcgggactttgacccctccaacagcacccgcagcactcgcctcattttcacctgagcccctgaccgcttccccttcatggcccactttcctccctgtcctggccccttcacgaccacaaagccgatggcggcgtcgcagcctgtgaggagaaggaggacgagctcgaggcccttctcttttggaggccactgaggcccttctccctcaaaagccacacaccaccagaccgaggggcccaccgaacctgcccgaagcccactggctccgcctgaagcccactggctcctcctcaccctcactcacacttcagcccctgggaggactggcctgcggatctaccagatgagtctcagtagaggaaaaaagtgtccggacagcaggaacgcgactgcacactctcacagctccctggcgttctccacgtgggc

SEQ ID NO: 2356 - DNA, 2700 bp, Homo sapiens
ctctccgcgtcgcagtcgtgcgccgcgccgccgaccccggccccggccccagacccggctccgtaccccgccgcagcctaggccccggcccccgccccggccccggccccggcgcggccctgggggcggatgcctggatgtggattttgccgtggggccaccaggctgttctcacgtgaacagctttaaggtgggagagaactggaggcaggaactgcgggttatctaccagtgcttcgtgtggtgtggaaccccagagaccaggaaaagcaaggcaaagtcctgcatctgccatgtgtgtggcacccatctgaacagactccactcttgcctttcctgtgtcttctttggctgcttcacggagaaacacattcacgagcacgcagagacgaaacaacacaacttagcagtagacctgtattacggaggtatatactgctttatgtgtaaggactatgtatatgacaaagacattgagcaaattgccaaagaagagcaaggagaagctttgaaattacaagcctccacctcaacagaggtttctcaccagcagtgttcagtgccaggccttggtgagaaattcccaacctgggaaacaaccaaaccagaattagaactgctggggcacaacccgaggagaagaagaatcacctccagctttacgatcggtttaagaggactcatcaatcttggcaacacgtgctttatgaactgcattgtccaggccctcacccacacgccgatactgagagatttctttctctctgacaggcaccgatgtgagatgccgagtcccgagttgtgtctggtctgtgagatgtcgtcgctgtttcgggagttgtattctggaaacccgtctcctcatgtgccctataagttactgcacctggtgtggatacatgcccgccatttagcagggtacaggcaacaggatgcccacgagttcctcattgcagcgttagatgtcctgcacaggcactgcaaaggtgatgatgtcgggaaggcggccaacaatcccaaccactgtaactgcatcatagaccaaatcttcacaggtggcctgcagtctgatgtcacctgtcaagcctgccatggcgtctccaccacgatagacccatgctgggacattagtttggacttgcctggctcttgcacctccttctggcccatgagcccagggagggagagcagtgtgaacggggaaagccacataccaggaatcaccaccctcacggactgcttgcggaggtttacgaggccagagcacttaggaagcagtgccaaaatcaaatgtggtagttgccaaagctaccaggaatctaccaaacagctcacaatgaataaattacctgtcgttgcctgttttcatttcaaacggtttgaacattcagcgaaacagaggcgcaagatcactacatacatttcctttcctctggagctggatatgacgccgtttatggcctcaagtaaagagagcagaatgaatggacaattgcagctgccaaccaatagtggaaacaacgaaaataagtattccttgtttgctgtggttaatcaccaaggaaccttggagagtggccactataccagcttcatccggcaccacaaggaccagtggttcaagtgtgatgatgccgtcatcactaaggccagtattaaggacgtactggacagtgaagggtatttactgttctatcacaaacaggtgctagaacatgagtcagaaaaagtgaaagaaatgaacacacaagcctactgaagtgacacacagacctacctgcaatggaagatgacgacaccaatactacaactggcatcgagatctaaaggacctacttgaccatggcccatgggcctgacagagtaagaattgaacagtacccagtgtccaaaaggtcctgattggaagagaaatagaaggggagggagaagaggctctagtctaagcagttgatgaaagggaaattaaatggtagaaacactctgggtgaggaaggcaggagcaggaaaatgctgacactggtacatatcctatattcctccaaaagattgtgtgggaaagtgtgggggggaggggggtggtggggggggagtgtgcccttgtaaccgtaaaacatctttctccatgggtgtttcagcttcaattgaccaatcacataacagttatatgtttggggggaaaaagaaaagtttctaaaaaatgtagcccattacatatatgggtatgaaagcagaaaagtggaggaggcagggatatcattgacaaacacctttgccagtttctttgtattcgtgattttttgtgctattaaatgcagtattaaaacaagaaaagcccacctgggctagtgaaaggagaggaaataagggggcttgtaaaaggggagccgtcgctccaaaagtagagaagacaagaaatgctgtaagataagcaaccaacgcagacaggcctcagctaagagtatagtgtgtgtgtgttaaaaaaaaaaaaaaaaaaaagaaaaaaaaaagctgtatgatatacttgagcaaatcaatgaacctctttgcgattgttttatcatctgtaaaatgcagataattcctaccttaaagggttattgttaaagataaaatgatataaaaatgtgtcaaagtataaagtaaaaggcttggaactttgtagggactcagtaaacgtttgttggatccaaacctgaa

SEQ ID NO: 2357 - DNA, 4666 bp, Homo sapiens
tgccacttctcttcccttcattcttcgccaggctctctgctgactcaagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaag

SEQ ID NO: 2358 - DNA, 2634 bp, Homo sapiens
atgtgaaatagtgacataacagttttatttttgaatattaacatttgtcacaaattacattatttgtagccaattgacatttgtgatgcaaaatatcagacatcaacccaaaaatgtgtgaaggagcacacgtttttcttaatatttttagagagcattttatataaaccaatagttttatataaacatacaaaacatatatgaggaattgtcatttactcttttgccaccttgtggtcagagttggatttatcacccaggtgcatctactgcgaaggagagctgtctctcctaaggatagccccaactgcctgcattctgtcagatctttgtgaggcagagatggtaacatttgctaggatctgggtccagatccacataaggacaaagcatctaaagattttggtgacaccctccacacgtgattcaaaacaaaagcatcatgtaatcaggaaatgaatgtaaggaagtacaacaaagttctgatttttcccacgaggactacttaaaaaaaatcaaatgtcaaactgtttctggtattttttcttttttgattttttgtctttggtgcctcttctctgctagtgacatagactttccttagtgtgccttttggggaagccatccctgatttcagtagccctggagtaagttggagtgctgtgtccacagctcttggtacatctggccctcggtcagtgcagaataaacatttgttgagtgaatggtgacagagccctccattttcagaacacgctggcctgggcagagtccaggtggacctatgggcttctgcaggaagttgatcactaagtcaacaagttaccatggctaatcttcaatggtagacagtcccaggtacacagagatctttaggtctttttgttgtcagtctggaggtgggatgagagtatcctccaccccctcatccatgacctcggttgtttttagcagcagcagcagcagcaggattccttcagtgagtgtgctagttgcagttcctctggttgcaggccacaaagggcaggcatttattgaaaggatgctggggtgcttcaaggaattgaagcaagagctgactcaggaagggtagggcccagggcaaccctcagttttatgggaaccacgcatcctcctttcaagggctcctgattcctgaggcccaactcctgctgctaaccctaggaggcctccccatcccctccctagaggaaggggccaggtggagagctgatgtccagtgctgagcaaggagaatgttgctagggtatgtatactcaggcagcacagccacacaagccagacagcgtgcactaggctacagccagccaccaccaggattaggggactagactcttcctagaacactctttctcctcctactcctgtcctgatgcctgccctgggctgcactctctgggaccagcagctacagcccgacaccctcgagccatgacccaggtctgagccacttgctctgggcacactcctcgtgggctctggggtgctgctgcccagtgccagcagccccttggcacaggggttcccagaggcctctcagcctcatgtccgactccctctccctgctggcagctccacaggcttctttccacttccacctgctgcccccctcccccgggatgctgccagggcttaagggtcttgggagtgtgtcctgtagtttaggccccctctcagctgtaggggaagtgccagctgtagggatggccttgtcgtgcctcgtccctccagctggccttggagagaagaggtggattgtgccatcgggctgctcagcgtctgctgggccaggaggccggctgtcaagccattaacccacccgtggccttgggagcccaggaggacgcgagcagcaggcccagaccctgcagagcgctgataagatgggccagggacgcgcctctccaggcccagcggccttggtagcccggcccccccggagctggggtccaggcctccccagaactgcagctggagcttcatccttttcgggaagcgcaggacctggcgtgggaagggagacagggacgaggctagaggcaggctcggccgccgaaatgatggcctgtcacggcttctgcctgcgctccctaggacccccctcagaggggacatttcacagcctcagaaacatttctggacttggcacccgctcggcccccagccccgcagtggccgagggaagcctgcatagacgaggggaaggacgaggagaggggaggagacgatgaagggggtcagagcagcgattggagccgagagctggaagcgccttaaagagactgcgcggtccccgccccccttcccgccagcctcaatgaattagagctgtgtttcccaaacttgcctgatcataagcagcctctggggccctagttagagatacaggttccggagtacctcccttcgagattctgattcagtaggcctgcgggtggagccaaggaatctgtaattttaacacgctccccacgtgattctcgtgaacaagcaagtttggaaaatactgaattaaaggaaacggggcctggctgcagaagcagcctccactagggggcttcggcgggaggattcccgggggcgtcgcctgcttccgccgccgcctccttcagt

SEQ ID NO: 2359 - DNA, 65 bp, Homo sapiens
tcttgaatccttggaacctaggtgtgagtgctatttcagtgcaacacacctattcaaggattcaa

SEQ ID NO: 2360 - DNA, 87 bp, Homo sapiens
ctgctccccctctctaatccttgctatctgggtgctagtgctggctcaatgcaatgcacctgggcaaggattcagagagggggagct

SEQ ID NO: 2361 - DNA, 85 bp, Homo sapiens
tgctcttcctctctaatcctttgtccctgggtgagagtgctttctgaatgcaatgcacccgggcaaggattctgagagggtgagc

SEQ ID NO: 2362 - DNA, 80 bp, Homo sapiens
tccccctctctaatccttgctacctgggtgagagtgctttctgaatgcagtgcacccaggcaaggattctgcaaggggga

SEQ ID NO: 2363 - DNA, 92 bp, Homo sapiens
ccgacttgctttctctcctccatgccttgagtgtaggaccgttggcatcttaattaccctcccacacccaaggcttgcaaaaaagcgagcct

SEQ ID NO: 2364 - DNA, 98 bp, Homo sapiens
actgctccttctcccatacccattgcatatcggagttgtgaattctcaaaacacctcctgtgtgcatggattacaggagggtgagccttgtcatcgtg

SEQ ID NO: 2365 - DNA, 85 bp, Homo sapiens
tgctccccctctctaatccttgctacctgggtgagagtgctgtctgaatgcaatgcacctgggcaaggattctgagagcgagagc

SEQ ID NO: 2366 - DNA, 87 bp, Homo sapiens
ctgctccctctctcacatcccttgcatggtggagggtgagctttctgaaaacccctcccacatgcagggtttgcaggatggcgagcc

SEQ ID NO: 2367 - DNA, 31679 bp, Homo sapiens
tcacattctgaccgccagggaacactggtagttctttaggtggcgtttgttgctgtgaaaggcagagaatgcagcaagtgcccttctaaagcacttcagactggggcttcttttgtaaaagctccccaacctgaatgaccaaatgcgggctgccaaggttatttcttccttgaggcagaaaaaaagaaaactgtgattgaaggtaagcagacttgagcctgaccaaggactgaagcatgccccccgggagcaggggatctggagaattgcaagcagtctgttgtaggattctaatcactgcctgctctttgagaggggcctgacaattgcgtttctaaggaaaccagactacaaaggaggatgatgcggtgctcatgttacctagtgatgtaataggattctttctttcctgctagaagctgttgcagatcttcattttgccttaatatccttaaaggtgggggcctcatttgatatatagtgtatcattagatagctatcagatgatttttaaaatcagtttcacaaaatcctatttttccccttctgaaaggagaactcttaaaccagagcaaattcaactggagcattaacctgccttaaaaagtaaatatctggttgtttggtgtcatgtgttcatgtcagcattggacttgagaattgaaacagcttgccctcccccacctccacacacacatactttatcctctttctgccctcatttcctagctggctttttccctctaagctctcaagaaacacatcagctttcatctttatcagtatgacactgacatgataggaaatgctgggctggtgattcagcagccatccattttacagtcaggtacgaatgaagatatggaaaggactttggttggggtttaagattaacttgttcaccttttccactccacccccaccccgcccccaccctacagatgatttggactctgcagagctttttctttcaaatgtgcaccttgcctgtgaaaggcatgctgacttaggtattcagaagacttacaattggtaaaccaattgtaagtacagcttggggtgttccttcaaactttccccatgacattgctaaagttgtctgtttggagtttacagtgaagatggggatgcagatgggaggagagggagtcagctcaggcccactttggcctcctctgcagagggattcattaccaaacagtctggaggaagccttgtccctgccaaggttggtgctgcaaatgtgagctttggctgggtgaattaaatgatggcattactctgcacttttccccagtgtgcatttgcatagattcctcagtactgttttgtattttgtgtttaatagcaaaatcttattccatcagatgatgttgctgaaatattttgaatcaagtttaagccttgtgtgagtatagcttgtgagtttaaaactttctcccccattcccaccgttcatcaaacaaattttggttcagctgatatatactgattcttggatatgtgctagacactgtagagaagggaacgatgaatcagacatcaggctaccagcaaagagcttgtagtctagaaaggaagataaagcatgcacaaaagtaattgtaatagaagtacccaaagcaaagtagataagggactatgatgggtgggcaggtggatatgtttcttgcagttgaaggatcagggagggacatttcatcactgaatcatacactgttctttaaatctctgcttgtaaatcttagactgtgctgacatacttagagttcctacaagcctgttacatcagagatcaagtcttatacctattgaagggaaatttgtacattccagccaacttaactcgtgaagaggcccacatgctttatttggagtccccagccaggcaaaaaccacttcataggattgaattattgccttataaatgtaaaatggttcttgatgtgatatggctgcaagtgcctttgacccttttgtctcccttccataaactgaaatacctaagctgctccaacctcctttttgtcttttgtttcataaatcctttcccattgcacatcaactcctgtctctctttgtactgtcactctcatctgttgctttccattcacactgcctttagccactcatcattttgtgcctacaccacagaaacctctgaatgtaatggatgttcctaccaggtgactgtatttctttatcaaccccaactgtagtcatctgatagtttaagggcccgccttttggaaccaaaaagaatgtattaaaaatgttaagaatttctgaagtactaatgtctatttcttgttcaatacagaggacaagtcgtacaatggtggaggaataggttcttcaaataggatcatggacttcttggaggagccaatccctggtgtagggacctatgatgatttcaatacaattgattgggtgagagagaagtctcgagaccgggataggcaccgagaggtaagacaaaagatggcacatgggtaagtgttaggaaatacaggggaagaaattgaagatacatattctttctattctttcctttcttcagccctggatgtgactgaatctggtttctgttggcaatatagagtttcatttttaaatttatttttgaagacatcttgcacataatttttttattatactttaagttctagggtacatgtgcacaacgtgcaggtttgttacatatgtatacatgtgccatgttggtgcttgcacataatttttatcctaaatttaaaaaattgtatttagtgatttatcttactatagtaaatagtcgcaaaggatcctcacagctaaaagggatataaatgcctctgaagagaggtgaaaacaaacttggaggaaggtggcaaaataaatgtcaaagatcttcctttcccatataatctctcttttatggttttttccttaatgcaggatattcataactaagaaaagtaaatggttttctgttaaaggaataaaagaaaaaaatctcagagccctagtgtttactgaagcatacaaagtaaactccttgtgattattgatcttgtacaaccataaaaccaaagtaaacttatgctttcaactccaacaaaaccacaagaccagttaaattcaaactggggacattaacttaatgtgataggtaatagatggtacttatggctatggcacaggttcttttgaatttagcaagagaatttccccacttttctctttttgaagtaccgtgaaaacttctcagagagacttgccaaggtcatttgcctttaacttgttgctgtgtatcatttaaattagggaatcacaatttctggtttgtataagggccacgtggagagcttattaaaaaaatagttgtccaaccccagagattctcagtaggtggtcctctggtgagtcacttcttcaacccacaataggtattatttttttttctttcttactatttctgcttggactccagatttgaaatgtgattttttaagctgccccattctctcccaagttcatgatttcctcctcttagaaccaagcaaatctcttgagtagtcaggtggagattgactttcgttcttaagcctttccagctcctgactggttttctcacgaccacctgaacccaggagtcaggttgtcccaagtacaggttttgagaaattccttcttaatccatggatatttggtgattccaccgagttttcttgtcacaactcgaaaagttgatcactataaagcatttcatgttttttcataagatttctgccatttgggaacatatacacatattctttctatcgtatgtatcaattcatcaggcgggctttagaatttctgccatctgtaatttaccagtttgtcatcagttgcatattcaacatgttatccagattatgagagtcacctgtgatatgacaagtgcacacttccttttatattaatggttgcatctgaggcaaattatgccaattagtaatccaaaaccagttaaagtgtgtttatcaaatagcccaagggggctttttgttttatagcattaactgttcattatcagaagggaaacactgtcacagggaaaaatgtaactttgttccttttcagcactgaaattggaaacttagagtcataggtcaaaactatttaaaaaaatgcttttgaaattctcagaataatttattgtctgtgacgttactgtagataaggtggggtaactaagttgccatttcaaagataagaaatagaggtacagagaaaggggaggtaccagtgacaaaactgtcagaatgttgatttttaaaatgtaggccctgaagggttaaattgtcaagtctaggacttaaaagataaaactttctgcacctcctgatagccttgatgttaccagcaggttgttgaaaatgaaaagagatacatcattgctatcacttagtatcggtgaccactgtacaattaggggtttgtgggatgaagtctgggaatttgcctgacctgaaccacagcccccaggtagtaagcctcaatttgtacttttatcactcaaataagcctgtgtttatttattctttgaaaaacattgaaactatttgctgtgagtcaagagattgcccttggaatatctgatgtccaggatagaaagataccactgcaataagcaaaacaagttgatgctataagaaatgatggcttgggaggaagctctgaataaggaacttgtgggcattacaatactgtagatgaaggtggggtttcggtaaacctcaaagttgttagtgaaactggttcagctaaagattatgtgaaaagtagctctaaattggtctctattctccagtgatttgtctttgtatttctttgttgaacagtttttaagtgaaaaaatggtgtgtgtagagtgtaccaatgttttctcattttcccctagattaccaataaaagcaaagagtcaacatgggccttaattcacagtgtgagtgatgctttttccggctggttgttgatgctccttattgggcttttatcaggtatggtaaactgttagttttcaaaacaaatctcctaaaattgtggtatgtctctcccgtaagtcctgagctgagtcacgtactgtgttttcctgtttttctaccttaaatgaattgctggtgaaccttatagaagctcaatgtccccatctgtaaagggtactaatacctgcaattcttaccttgaataaatgaggaaatgcatttaaatgcattttgtacactataaaatactgtatccattttaaggtgatgttagccctttggtgcttgttttgaggaagagcccttctgttggagacagttttttttttaatacatactgcatgggttttaggagataagatgtggaagaggacttcctgagacattttgtgggtgtttcttaaacatctactctctcatttggtgatgcagaaaagcatgtaagatatggctcgtactcccaagaagcttatgatctcattctttcatagtggctgggggtggaatggtgccaccttgccctataaactccatcaaccttccctgccactccatataatatacagtctcactaaaaatggtatacttactgtacaaatacagctttcaaccaagttcccaagaaggtttctcacccggtggggagaggagagggccaaggacactaggtagagatggtaagaggtgtgtccttatggcattaaaggatagggcctaggcaaatctgtaatcttgagctgaaagagaagttaggtggaaacctggaggtggaaggtatacagtggtagttaacagcaagtagaggctctagttttaggctgcctggatttgaatccaagccccaccacttgctagttttgtggctttgagcaagtttcttaacccctggaagccttagtttactgatctgtaaaatggtgataatcaaagtccctatgttagaagtttgctgtgaggattaaatgagatatagcacataatagcacttattaagcacagcagacagttgttaatgctgctgctgctgccgttaccaagagagaataattcatgagccatggagtagaatgtgactgtagcaaatgaagaatggcttatctatagctgggttttaaaaaattgtctagggcagggattggcaaacttctgctgtaaaggagccagatagtaaatattttaggatttgtgggccaagtgttctctctagcacccactccattctgctgatgtggcacgaaagcagccatagacaataggtaaacaagcccagctgtgaccagaaaaactttatttgcaaaaataggagacagacaggatttggtccttgggctatagtttgccaacccatggcctagggtgttaactctgccccttctggctcttacaggagagagaacatggtctggctctttggagctgcctaataatagactgggtggtctgtaatgctaagtattgcagagaggctgaggacaaggaagatggctgagaaaagattatatgacctagcagttaggaacacagcaattaccttgaaaagccatctcagaaaaatattagaagctaaatctattcggtttgtgcaaaagtaattgcattacttttaatggcgaaaaccgcaattgcttttgcaccaacctaatagatttcaagggaaggcaaccactgtagaagttttggtagtcataggagagagaggaagggtaaaggcttgaaatgataacaaggacaagggacagcattttattcttcagggtaggggaaacctaatacaatttgtaaccagagaagaaagaactgactctggggaggaggagaggtagaaggagaagacaggattgagggtaccagtgttaggtgaaataagacatgtacacgtgagacaaccagagaataagccaaactgtataacatcatggtaattttccgaatccaggcagtaacagatagaaggcagagaagattgtggaccggagtggccaagagtaggtgtcaaacaatgtgttagatttgactagattcttcaagtatgtaagtaacctgtgttaacacttttagcacctaccaaaacatacacgacatggcttcccgcccgttggaatgtaggcataatatcctcaactttttaatgtatttcttgtcactaggtggtcagtgaatatttttctttcccttgtacacacagggtattttgtttttaagcattggagagcaacaatagaagcagtgtgtctgaatgctggaacagtctgggaattcaagggctgtgaattttgtgatggctttactatttccctaaagcatgattctgggccatttaatttctttatgccagagtttcttcatctggatgacagaaatgatgagaaggccagaatctaaattactataactgtcttaaccctatcagtctattagccacagtgcatcctaagtccccagttcacgattccatttcccatcattttctttggtgaatgttctgtgtataatactgtttgctctttctcagtaagaaaacttcaggatgttcatgtcctaggttcaggaggcctcaacatgtctatagcttcatctcaccttccatgcacatcacagtttgtgctttgatagattcagctcctttagcctagaatgccttcctgccattgctcaaattcccttgtccatggagcacaatcctgctattaaggcttagcccttctccccataatcttcgtcagctctcctctctaagcaatctcaaataaacatcatagaatattcctcaatgttgggcaattcacatattctgaatcttgtatatatgtatatatgtatatgtatatatatatatgtgagaataaaagaatctttaataaacttgactctttatggatcagtattcataaagttgaagtcaaaatagtgtttttgccctgttagttcagcttaaagacaggcccactagccccttgctcccacttaaccattttgctttccctaagtcccttctatgtagaaattccacagatggcagtgtttagtgcagagataataagtgaaaatcaagcaaacacacaatgagaaagaggttacaggtggaatggggaagtatgtgcttatctgttactttgattcctttcccctcattttctctgacaaagcttattctgatgaccaaagaacagtttccgagattcagtttaactttggcctttccctccctccccacaaatcaggttcgttagctggtttgatagacatctctgctcattggatgacagacttaaaagaaggtatatgcacagggggattctggtttaaccatgaacattgttgctggaactctgagcatgtcacctttgaagagagagacaaatgtccagagtggaatagttggtcccagcttatcatcagcacagatgaggtaacatgtagtgatgttttatgagccattgacttttcttcttacatttattttatttcttatactgtgctcacagcaattgcggaatcttcctttattttcctttccacagaaaggggaaccagtaccagctgcctttctctgtggtttaagtgcagctctatttccatctctgctgatgtgtagagtcatttgacgcttatgtttaaaatggttttttgtttgctttactaagcctggtatttcttcttaggtactagtacatagtgtgactgaatttctctttttctaatcatttcaaaagaagtgtcagaggcagccaacaggtgagctataatttctaatgaaggacagagtgagttaaaaatgtgtttatgtatatggatttgaaaagtgattttccctgagcattgcattagaacattgaaaaaagtacaatgcattccatgtcaaaataacagaaacccaggaataaaattgcctatcatcccattttgtaatcaaatcaatattttcatttgtccttgtcttctagcatacgtttttgttttttttcttgagacagggtctttctctgtcacccaggctggagtacagtgacatgaccatagctcaccactgcagcctcaacctcctagcctcaagcagtcctcccaccagtcctcctcaggagtagctgggactaaaggcgtgcaccaccacacctagataatttatttatttatttattttgtgaaaatggagtcttactatgttgcctaggctggtctcgaactctttgcctcaagtgaccctcctgccttggccttccaaaatgctgagattacaggcatgagccactgtgcttggcctaccatatgttttttgatgccaaggtaactttgcttatttttcagttccttacctttattttaccactcagttatatgtttgatctctcccactgaaaacaaaagcacacaaagcaaaaaactctcaactcccaattccaccctgacttccaccaacaaagacaggtaccatcttagttcactactcatctattttgttagtgagggaaacaagactaggatgtatgtttgtacttttaaacatttatattaccctccttggtctacaaacaatttgaggtggcatgtgcacacacatacacaaatacaaacagtccagggaaaaggaggatagaaaaagaataaagatagaaataggagtgtttatatacatgtatgactatgcatcttggcttaggtaaagggttcaataaaagggatagatacatgccgtatgtttgagagagtttaggtctatgcttctcaaactagggtaaggtcagtgtgccagagggtaggtgaaactataggacaaacattatttgccttcccagagcattactttttcctgaatatttggaattttttttcaaaaattatatgtaaataatcatttaaaaatggaatgcaaaatttcatacttgttaagaaaaaaaaaaatctttcagctctgctcccgggtaccctgtcccatactctgatgcctttgtttactctctcctagattaggagaacttaggtagaaaagtttgagaagtcctacaacttagggtgggtgtgaaagagagagagagagagagagagagagagtgtgtgtgtgtgtgtgtgtgtgtgtgtgtgtgtgtatttcccttgcttttggggggattcttttattttaaatgtaattggccaggcgcggtggcctgtaatcccagcactttgggaggccaaggtgggtggatcacctgaggtcaagagtttgaaagcagcctggccaacatggtgaaaccctgtctctacaaaaaaaaaaaaaaaaaaaaaaaaaaaaaaaaaaaaacatgtatatacacacatatatatataaaattagccaggcatggtggtgagcacctgtaatgccagctactcaggaggctgaggcaggagaatcacttgtacctgggaggcggaggttgcagtgagccgtgatcgcaccactgcactccagcctgggcgacagagcaagactctatctcaaaaaaaaaaaaaaatcctctcctccaaggactgagtgaggtgtgcctcatgcctgtaatcccagcactttgggaggctgaggagggaggatccctcggggccaggagtttgaggccagcctgggcaatatatcaagacccctgtgtctaaaaataaaaaaactgggcgtggtagcaaccacctatagtcccagctactcagaaggtgaggtgggaggattccctgaacccaggagatccaggctgtagtgagcaatgatagtgccactgcactccaacctgggcaatggagtgagatcctgtcacacacacacacacacaaaagtaattacagattcataggaagttgcaaaacaatgtacaaggaggtcctcagtacccttcccccagccttccctccctcaatggcaacagcttgcataaatgtagtaccatagcaaaaccaggaaattgacataggtacaatccacagactttagttcaccatttagtttacacacattgatttatgtatgtatttgtgtgtgtgtatgtgcgcgcacgcatgtagttcatagttcattgccattttgtcctatgtggacatttgtttaaccaccaccacagtcaagatttagaactgttctatcactgcagggctgcctcatgctgcccctttatagctgtatgtgtgtaagcattccaacagttactttcaaactggagcttgagatttgctctagtgacagatttctctggctcttctttttatgaacgaaatccttccctggggaaagagtcctctaggttttggtttttgtttgtttgttttttgagacggagtctcactctgtcacccaggctggagtgcagtggtgcgatctcggctcactgcaagctccgcctcccgggttcacgccattctcctgcctcagcctcccaagtagctgggactacaggcacccgctaccacgcccggctaatttttttgtatttttagtagagacggggtttcaccatgttagccaggatggtcttgatctcctgacctcgtgatccgcccgcctcggcctcctctaggttttaagaagccttctccaaatgccaggaaattgccctcctggtctctgcctctggccagtttgagttacttttcctttcactcccttaccctcttcatttcctacctctgcagtcttcttcctccttagctacattggaaaggcaaagaaatagcaatcatgtgttcctctgagggcctaagataatggaaaacctgtgtcaaatttacaactcagaaaaaacctgagcattctggttctctttgtctaggtcagtgagttactttaatagtgttttgtgttatgaagtcaaaagtccattgggttttgtatttactgagtgagttgcaattcctaatatttctaccagcaagcataacttcctaatcaaaattgctttttttgtaagacatgactatttgcaggccctttaatatggatgaatctttcctgctggtcaaagctagatttcttttgtggcatgcttcatttatcacaggggaatagtctcaaaaagtatattctttctattttaaaaaatagttgtttccattttatttatttatatctggtaccaccagggtccaaaactttctacttatatggttgttcctgagtctgtggtaccaaaattttcttgaagatgtagttatatgtggactctaaaaaagaaagttgagtaaacagaaccagagagcagaatggtggttacctggggcatggaggaggaggaaatggggagaagtggaccaaagggtacaaatttgcagtgaggtagggtgaataagtctagagaggtaatgtacagtagagttaataatgctgtatactaaaaatttgctaagagtatattttagatgctcttaccacacatacaaagaaaggtaactatggaaggtgatatgcatgtaagtttatttcaatgtagtaacaatttcgctatatgtatatatataaaacatcatgttgtacaccttaaatacatacaataaaaaaattttaaaaagcaaagaaaaaagccaaacacccaaaattttgttactataaactatgagaatttgacaccaaggtaagtagccaaaggtgaatttagtggaactttagatccgctcttcacttcagatgtgaagccaaggttcagccattccaaaaaagctgggggggtgctcttaagactcttggtaaaatgacatggaatcatatatatttgactacaaaacccatcaaagcactcatatagaaagagaattttgtttcatggttttccgtttgctcttttccttgttcatccttagaatccatggtaaatttcctttgggtgtagcaaagcatctcattttcagtactaagtggcctgacagtgtttcagtagttgacaattcagaaagaaaagtcttgaacaatttaatctcggtggttttttttttttttggactttttttcctgaaaaaacattactcagaagagctgcatgtctcactgaagctgtctaggctaaaacaagcttctttttccccctgttccagggagcctttgcctacatagtcaattatttcatgtacgtcctctgggctctcctatttgccttccttgccgtatctcttgtcaaggtgtttgcgccttatgcctgtggctctggaatccctgaggtgagtctcttaaaatggtttataaatggttacaatatgaatactttttggttaaaatctcttaatatgtattccagcacataccacaatttgatgaatgttaaacaggatcagatcctgaggccatctaagacctaggtctttccacaagtccctctcagcctgggctaccaggaaattaaagggagttgattcttagcctcctgagggttcctgttgagccaggctctggaaaacttcccctgttccctatccaaaaagcttccagagtatatcccaagattctgacctgaaaaagcagtgttattgtcagctttttcagggcaaaagaaagaaaatcatttggtacctttcccacaatatgatttaggctacatgggatggttaaaaccctgtttctaactacttttggcttagattgcttgacagtgactaaagacactgagacttaggttaccaggatgactttgcccttccctgtttcctgaccaggtaataagtcacaattttttttttttttaagccagggaatcaagactatacctaacctttaaggttgtttcagggacattagccttgtcctctcaaaacatgcctcttgggctaccacgttgtaacatgaggaaaacacctatccctccctctccagctcctccttcatatatgcacactctcatacttacaatacatccttgcccagctatcactcccctccccctaaaaagggggaacatgaaagcttaaagaacagttcttgctttcttgggctcctgggctctcttccaaacagggatcactgtaggtcaagcatttatatgtcacttattcaaaaggtgcagtttctataatgaggtccagatttttgcttcttagccttgttgacttccttagtctatattcaatctttctgtgtttaacctgcagataaaaactatcttgagtggtttcattattaggggctatttgggtaagtggactctggttatcaaaaccatcaccttggtgctggcagtgtcgtctggcttgagcctgggcaaagagggccctctagtgcacgtggcttgctgctgtgggaacatcctgtgccactgcttcaacaaatacaggaagaatgaagccaagcgcagagaggtaataatgaatggccttaatagtctctttttggttgtgagcataaatgatacaatcttagggggtgagaatttgagagttctaccaatgttaatgcaaacaccctttgacccagcaattccacttgtaggaatttatcctacagatatcctagcatgtgtgtgcacaaaggtgtataaggatagtgcagcgtctgtcaacatagtaaaaaactgaagcaacaaaaatgtccatcaatagggaactgatctaataaatactattctgttcatactgtagaatactttgcaaccattaaatgagataaccttttatatattgacttggaattctggctatgaaacaccatttgattttaaaagccagtttctgagtaatgtatataatataattcatattttttaaaagtgtacatgcacttattgatagaaaatgtctggaaggtggttttaccccaaactggttttacttttttttttttttgagacagggtctcactctgtcacctagactgcagtgcagtggcatgatcacggctcactgcagcctcgacctccctggctcagatgatcctcccacctcagcctcccaagtagctgaaactacaggcacgcaccaccaaacccagctaatttttgtattttttgtagagacggggtttcactatgttgcccaggctagtctcgaactcctgcgctcaagcaatcctcctccctcagtctcccaaagtgctgggattacaggcatgagacacgatgcctggctcacgtcaaactgttaaaaatgtttatctatggtgagtgggagagtgaggggtagtgaaggagaagtaaggattttaactttttattgtatgtaattctattcaagtatatattgcttctcttacaaaataagttacagaaagaatagattttaaaagaagttgtttattgctatggaatagtacatataagtgcagtgtatgtttcagatgtcggttttttcactttctatttctatctaacactatacttgaattagtttctctctgtattggacctctctctaccttttgtttcagcccagctaaattagtcccgccatggcacctctgtagtggctgtcatgtttatgcagttgttaatgtatgctgttttgaggaggaaggacttttttaaaaaaaagttccaagtcattggtttacttttttcttgctataattaagggcctaagagaataatggctcttgctttattttctttgaattacaaagaagtcacatatggaatgggtcaagactaaggtcatttcacttaaaaggatttttcacaaaacaggaacctaatgatttcttatgaaaaccaaaaaaaaaaaaaaaattaaccacaagacccagaaggaaactcaaagatattgagatttcaaatatagaataaattttgttggttcaagggagaaaggtcctggcactgttagaaaggagaggaaagctagcaggagagaagatggggaaatatgagtagattgtttaactacctgtcatgcagtagagggacttaaaggtagtgttaagttggtgaggttgttaaatgggaatgacattcaacagaagggaagagttgagaaaacattttttttctagaagggctttattagaacagttatgaaatttgaatgagatttatagatcaaataacagttattagtgtaaatttcctattttgatcattgaactgtgattatggaagagactgtctttgcttttaggacataaaagcatttatatcctacatgcactgaagcatttcagggtacatgagccttatatgtgcaactgacttttctgagtgaaattccaattcttcagaaaaaaatagaatcataaaacaaatgcagtaatggtagcaattacagaagctacatgaagatatgtaggacttctttgtgctattctttcaccttttctgtgtttgaaatttttttaaaaaaatattataatggttaagagtgaagtggtgattgttgctggttttgcatggatgaaggtgaatttgaaactacagattgctggggactttcattctaaaaattggcatttttgttcaaatagtttctaataaaataagaggggaattcgatttggctgtttctctctacagatgccatatatttctccagttagactcatatgaatacagtcatgtctcaatgacagggatatgttatgaaaaatgcattgttaggagatttcgtcactgtgcaagcattatagattgaagttacacaaacttagatggtctagcctactacacacctaggctttatgatatagcctatggctcctaggctacaaacatgtacagcatgcgactatactgaatactgtgagcaattgtaacacaatggtaaatatttgtgcatctaaacatagaaaaagcacagtaaaaatataatataattttatggggccaccatgttgtatgtggtccatcattgactgaaacgttgttacgtggtgcgtgacagtatttgaattggttttttttgtttttgtttttgttttttttttggagacagggtctcagtcttttggccaggctagaatgcagtagtgtgatctcagttcactgcaacctccatcacctgggcttgagcaattctcccacctcagactccccagtagctaagactacaggcacatgccattatacccagctgattttgtgaatttttttgtagagactgggttttgccatgttgcccaggccagtgttgaattcctgggctcaagtgatcctcctgcctcagcctcccaaagtgctgggattacaggcatgagccaccacaaccggctagtatttgaatcttaaatttactttctagcacttatttagactttccagttattttttcctgttgctttcatcatcagcggcaaccttttttgtcttatggccttgtcaaagtgggcagatggttgagagtaaaacagacttgagaaagaagggtgtagacagactccactctacaatataaaattaaagcaaactagctaccccgattctttctgtctcttgattcatcctaaacatagtcactgaaatcccctttctcaagttgcatgttggctgtcctcatctttcttaaatgaaagccattgtagctaggaatttcaaagcccttccagctagcaccagagattccattctttcctccccatcattttcctgagccatcctactcttccagataatcctatatgcttattttgccaaggacctttttattcttcaaaactcgtaattttgttcaactttctctaaaatatttctttacttcttcaaatcatctctctccatagcaaccagaatccaatgaaaggacttggtccatctattaattttggtttgtttgccattattagtgtttgtcatgtacattttacatgtacacacacacctacacagaggtggaggtctctaagtatcactattctttctctctttatcactttttccctttggctccttcttcctctcccactctctcctagtccctttccttgccatatcttaagtcttcccttaaaaatctagtcacctccctatttctgtgtccataggttattgggcatggagtaggacacagggtacgagagactctaaatacctattgcatgaatacttgcagctgctgaataactgtgaaccaattgtgacttcagttttatgtcattagagccttcttgaacatctcatttaaaaagcattcctttgcaaagttccatataaataaatacatcactgtaagtacatcatttagatggtgaacaaataggcctagaaattcaaatgcagttactgaattgggagtatgggagataagggcgggggggcggtgcataatttagaataaaacacatggctaaatgaattacaaaggaaaggtcctcttacctggtcaagcatgtgaactatgcatgtgtattcaaaattcagcatacagtgtttgaattttgtttttgatgatatggaacatctagaggtatttttaaatgttcagtaactactaacatttcttctaaaaatgtgattgagtgattgaggaaagcagcattattctgtcactaattctgagttttggattttaggtcttgtcggctgcagcagcagctggtgtatctgtagcctttggagcacctataggtggagtattattcagccttgaagaggtaacaacttttcattgtacagcatgtgcatgcttttgtgtcaggaattttgtacattgcagcgcaataattttgtacataatgtacaatatctgtgtatatcccagtccctgagtgctctccccaacttggtgctttaccatgtgactagaaatccagtcggcagttttcatccattagttgactctcatgcctgcagcacaacatttcacctgaaatagtttctgcgtattgactgagtttgctttctcaccttctttcttctaggtcagctactattttcccctcaaaacattgtggcgttcattctttgctgccttggtggcagcattcactctacgctccatcaatccatttgggaacagccgcctggtactattttatgtggagtttcacaccccatggcatctctttgagctcgtgccattcattctgctgggcatatttggtggtctgtggggagcactgtttatccgcacaaacattgcctggtgtcggaagcgaaagaccacccagttgggcaagtatcctgttatagaggtactcgtcgtgacagccatcactgccatcctggctttccccaatgaatacactcggatgagcacaagtgagctcatttctgagctgtttaatgactgtggccttctggactcctccaagctctgtgattatgagaaccgtttcaacacaagcaaagggggtgaactgcctgacagaccggctggcgtgggagtctacagtgcaatgtggcagctggctttaacactcatactgaaaattgtcattactatattcacctttggcatgaaggtgaggaattcttttgggactcagtggctgcatgcgtagctgtgggttttggagggcagagcccaggtatcatacaatcctgatagctcatatggtgctttcaaatccccctcacattattcccccacccccaaagcctcttttaccccacacgttctcataatttgctagacacttgtacctctatctcaaattgtccaagccttgagttgtccaaatgccagcctcagtgatgaaattttaggaagaatgtttgctccttttctgtggaaaacatattttgcccctcaaaaatgatggtgaagtatttattccagtacatttcatattaaaatgatatctgaccaccacagtgttactccttatagggtggctttagagtttaccaataaagcacaatattgattgaaccaaagaagttgctgggattcgaccattttgactgctaaaatggcaatttcctgtggttcaacccaatatatagctaaatatagttttttacagtggtatcaatgttcagttgtcaagaagtgggatccacttcacaggtgatccttagttaatatttaagctatcaaaagtggacatcaggctggcacgttttactttaggtacctgttaccatttccacgtttcagaagaagccagaaaagaaaatttgttaaggtattttcctcctcctttctaggtttttgtttgtttctttcttttctttagcaccctaactaccaagttattttcctctattctctagagaaatggagattcaagccagaagagatagcaactcagtttaggcattattgtaatctctaagatgacgccatccatcccctcaatacagggaagggatggagaccctgagaaattttgcagtgcttcttgagttaattttcacctcatgcctgcattctttcacttaaagggaatttgtaaaccatcagaacaccagattcaaatgcattccaaaatcaaacacaggctattttaaaagaatctgctgttttggttatccttatcatcatttccctctctcagtacagaatattaagaatttactatagtatcctaggagtcaagaaaaagagtggggagatagatgagctttacttttttggttaatcttgtaaccatagtcatgatctcattacaattttttaattgtttaatctttcttgatactgttacaaaatagactgaaacctcatgtgctatatcctttttgtgtgagcaatgggctaagattcaatatatgagcatggttatgagcattccatttaaatcccagcaccagtctttactaaatcttgaccttgggtgggttacttaacctctctgaaccttaggttctttggcatttgggaataataatgcctgcctcctggggttataaagaacccatgaatcttgcatgtagagcgtccagcatagaacatggtaggtactcaataaagggtagtcattgttgataagaattcaaaattggtggaaatgtctgcatatatgagaaactccatctattttcctttttctttgggaaaggcccaatttctgcctccagttctgtgttggtctggagagttcaggctcttgcctgatggaccccgaatcagggtaagcttctttgcagtcgtccttgcctgcacgtcccagagaacctctagtccctgtagtgttacacacacctttacagccacttgctagcatagtgcatagttaaattgtcatcggcctgtttgctttgcagagggtcagtcctccagcccttaccatgtgccaagcaatcacatcatttctcactaaccatctattggtttctctttgcagatcccttctggcctctttatccctagcatggctgttggtgctatagcaggtcgacttctaggagtaggaatggaacagctggcttattaccaccaggaatggaccgtcttcaatagctggtgtagtcagggagctgattgcatcacccccggcctttatgcaatggttggggctgcagcctgcttaggtgagtagtgtttgcattaatttcaagttgctacccaggtgacatacaacagaagagtttattaaacacagttgactgtaggagaatttaaatgcccatccctttccagttaggtttgccattttccaagcacattaagaaagcatctggtatacagatgaggaaactaaaaaaaataaaaataaaaatcataataaaaaagaaaaggaattctactctcatactggggaaataatcagaaatttagacaaagatatctgcacaagaatatgtatcatagtataagagcaaaaaattagaatcaacctaaatttgcacttgagggactggttaaatgaattatggtacatccatatgatgttatacaatgcagcctttaaatgtgatgttaattgttaatatgtttaacatcttaaaatatgatgttatataaatttgtaataatatgcagaatgttcccaacataaagtagagggggaaacatggcagaaaattaaacatataatgtgagttcactcatttaaaaacatatgtttttgcatagaaaaaaacttgaaaaagtcattcagaatttttactctgcttatttattggcagtcagctaatagataatgactttcttttatattttctggattttccacaatggcatgtattttctaattagggaaaagaagcaacagaaaaatgaaagaacaaagaaacaagaaggcatcttggactggacatggtagctcacacctgtaatcctagctacttaggaggcagaggtgggaggatcacttgaggttaggagtttgagaccagcctgggcaacatagtgaaaccccaattcgacaaaaaataaaaagttagttaggtgtggtggcacatgcctgtagtctcagctactcaggaggttgaggtgggaggatcacttaagcctggaagatggcagttgcagttagtagtgataatgccagtgcactctagcctgggtgacagagcacaaaacccgtctcaaaaaaagaaagagagagaaaaaagaaaaacagaaggcttcttgtagatgttattttgagaactctgaatcgtctccattgtgaccttgctttcttgcaatctctggggtctgcacagttgtaggtgagacctcattgtttttggtaggtcagcttttcctggaaaggcccataattgtaagaatcctgtattttgcctacctgagtagactgtgtctatttctttgcaggtggggtgactcggatgactgtttctcttgttgtcataatgtttgaactgactggtggcttagaatacatcgtgcctctgatggctgcagccatgacaagcaagtgggtggcagatgctcttgggcgggagggcatctatgatgcccacatccgtctcaatggatacccctttcttgaagccaaagaagagtttgctcataagaccctggcaatggatgtgatgaaaccccggagaaatgatcctttgttgactgtccttactcaggacagtatgactgtggaagatgtagagaccataatcagtgaaaccacttacagtggcttcccagtggtggtatcccgggagtcccaaagacttgtgggctttgtcctccgaagagatctcattatttcaattggtaaggatttcagaaaggggatagtggaatccactgtggaactcaataaatatgcctgaaatgggggaagacagggaaggggggactggttaggagccagaaggatagagctagcacgtccatcttcaatttgttttttccttctgtttgaatagaaaatgctcgaaagaaacaggatggggttgttagcacttccatcatttatttcacggagcattctcctccattgccaccatacactccacccactctaaagcttcggaacatcctcgatctcagccccttcactgtgactgaccttacacccatggagatcgtagtggatattttccgaaagctgggactgcggcagtgcctggttacacacaacgggtaagaagtcttgagtgaagtcaaattgaattgtgggagaaagagaatgcagagatagaaagaagtagaaagaagtagaacccagtttaaatgaacattagtagcacttttaggacttcttgaagctctgagatgaaagtggataggtttttttaaatcataattaatgtaaagggagtttgggaaagaacatgtgtttgagagatgtgaactgctggttgcatattataaataacccagttcctccctgacaaaggaaacacctgtgttttgtgcataggcagcactgaaattacagtagcatcaggtaatagtgtatttgctgggtgtttgttccctacaatctccttattattacttgaggatgagaaaaccaagtttcagtgaggtgagatttatacaaagttctccagctaataaatagtagagaaaggctttaaacacaagtcttctgactcccaagcccatggctctttccttcctgggatagttcttatccagtaaagggaacccttctatttttattggaaaagaaaggaggttgaggagaggggtggatttttttcccaaacatgctacgttaatccagcaattatataagaatttcacatctgaaatttctaaatggtgtaacagatgccttgcaggatttaaatcagtaaggggagttccctaactggttcattcaacatctgctgaatccctgctccatgtaagaaggtactccactggattccagggagacacaaaaattaataagacccttctgtgccctcaaggagcagacagtgttttaaggaaggcaagaacctagcagtggttatagtacaatagcaaagaggacaagtgccactgaggaggcctgcaaagaatgtgcatgctgttgctgtgaggagggcagagttcctgctggctcatagaatcagggaaggtgctctggaataggggcgtttgaactgggctgcagtagataagattcagatatgtagcgaagagtatttaaaccagaggaaatcgcagggtctgagacctagaggtagaaacacttgcatacatttaggaatccacacatcatcctatttgcctggggcacatgtcctactcctgtgatctcatactgaaagggcagctagtgatcaaagacaaagttgaaaaggactgaggaggacaagtatcacctttgggaatgctattttaactacagatttatttttgtttttttgtattgtgtttgtcttttaggcgattgcttggaatcattaccaaaaaggatgtgttaaagcatatagcacagatggcgaaccaagatcctgattccattctcttcaactagaatcatagagttctggatgtaaagcgggaaggacattacagaccatggatatgttgtattaactgggtacccaaaacacattttccatatttggatggtgaagtcacattagtgtgttgtctctttcctacaagttaaccagttgcactacataatctctggaaattaattttctctttaggagaaattatagttaggcttccatgatgttacattaggaagatatcatgaaagaataaataagattgctatggtttaattatatttgctttttaaaagatttttttaacttaaaaagtagttagccaatatgcaatcactgaaaactatgcaagagaaattccaaccgtcctgacctataacctgtaggaaaccgacgaaaaagtcactcttttgggatctaactgttgttactggaagacgaagtgtaaactaaggggctttgcttttcaaaccagagaaaggaaagccagaaggaaaagagtaatggtattttctagactgtgaagattcagttcaaatgttatccttgttcctgttacaatatttagcattattagtttgttatgtgtgtatgtttatgttaattttaatttctgattataagacaatgctgctttggttaatctcttctaaatgaatttagagagattgacttttatagcttgcttgttgctggtactcttttgaagtgcacaaagataagttatagagctttctccttgtctgcaaaaacggtaattttccaggtggcatttgttagctggtagacaaggactttgccgtgaatttgttagtagcaaggaatgatttcttccagcttccttgaaatgaataattagtaaacttctaagcaaagtcaatgactaggagtttcacatgtttgtgaggtcctaactaattctcttacccagatgccacctccatgaatgatggtgctttaggcttctggaatatgtaaaaacagcaaagggaaccaagtctagactgcatactggtaaaccagggaagactcagaactgcatatgcatcctcatgcattcctttgtaaagaccaccagtactaaaataactggacactcattgtacctcccagcgataagtatgtgtaacaggccagtgtgttgtccccatgatcatgaattaggcttgggatgcttccaaatatattcaaggtgttggaacaggataggcagctgtgactccctcaagagtccttagaattctaaataaaatgcagagccatcctaagacacaggggtatggacaaggcctggtgacaccaaaggtgcttgtatccaattgaaaaggtgcctgtctcaatttcataccacctttattgcagttaaaaaaaaatcacactctggggacacttggtggaattacagagccaccatcatcattccaaccactatttcattttctgtagttttacctgtgtgcaattactccccctccattctgttccacttcttactccttagtaccaaatcctctgtttgggattgagcgctgctcctggttaatcattcctactacaaaaaaaaataactcccagggctagttaaattgtaaaccaaggctcagcagtctcacaacacatggaccagaggtgacacacagccatttcctttgccatgtggcccagttgctgctgccatgcctccatttccacactggatgcctacggcagtgagatttcactgccggggtaagagttcagcctggatgattttatagctctgttcctagcacttctcatcatccttccagcccagaatcagcggtcattctgcatattcccaccaaccctctacccccaaacacttcagtgtacctcattttaagagttgctgatccctgattctaggacgtttttacccatagttcttgtctttccaaaatctgaaattcttttttttgctcagaactgggtagccaagggttattttatttttatctttaaaataatcaaggcagtcgctagagtttctccttgtgaatagatcactctagcattttaatgaaaaagaaaaaaatctttctggggtatgttgtatcatagtaatggctcagtaaccacatattttgtcctttccatgtcactgattccttcatatgagactatttggcttgactaccctgtatattgtgtagaaatcaaagttcttatctgtacatttctggtccaatacctgtcttattagttgtccttccccactaaagtttgcaaaacagaaaatgttactatttctggtatttaatgacaatgaaaggtttggtcatatttcatagtgcagtagcgataaggagggtgtctcaagtttgcttttgtgtttcttctaggctttgttcttgattttagacagatgagccagtgttaaggtgctacttcagagaataaattagagaaatcagataacactgtgccaaggtatactttgtagatgctaagcaccgattggccctccagagaatgacaatatccctttgatacctcactcctgatcaatctcattcattaacctcagcttctcaggaatccttgtagcttgtatgctagaagtagctatggtatatggtatccactatatgtccagtcctatggtttggctcaaaggttggctaattgcagctagagctctcaactgctagctcagcaccttgacatttgaagtttcttgtcttgaggagaaggaaaatgttctttctgccattgccactttaacagttggacatgcttaagcaacaaatacagccagtatagggaggactgtcagtagcatcaaatggccacatacctcaatggcaaaagactagatggtttgtgatttaaaaattaatgagtcgagatgagactattttggtattaaatgagaaaattgcctaacacaagggaagggtttacaaaagaatgccaattagtgtttcaacagagttaggattttccaagtaagagtagctggtagccatccagccataaaaggaacgagagtctatagatttgtaaaagtaaaactgctatattttgtatcttcaaatcttcaatataaagaatttaaagaacctgaaacagttaatgcatgattcgttatattggagggaaaaagcaggggactgataatacaaaataatggcaactttaaagatcatttctacgtggatgtttggttagaaacatattccaatgctctcctctttctctggccacagcatcctggctcagcccagctgtggagtagaggtggtaagatccacagaacagatatcctctggtagataagctgacattgatgatactttgaatttaccagctggtgaagcaaacgattaatttgtgattgaactgaaaagcagttgaattgttttgacaccagaggctgaatctaaaccctttacaggaagagcagagcatactatacatttcttagcagatcttcaattctgtttgaacatgatgaagtaaccagggtttagtgagatctaaggccgtgaagtaattcacaaccaagatcttatgaacgcattcagatgtgaggggggcaaatatgttttcaaaaacttagtgtgcaatagagtccattatagaaattaaccactgctatatgttttaagtagttcaatcacctgttgtggttcagtcttgattattgtttattttgttaggtgataagtaggaagatgcacttgttatcccacactatctcttgttttgttttgttttgtttttaaataatgaacagtgcaatctttgaacttgagtttttaataatgatagcaaagacaatggtgagaacttgaaacagccagcatattttatattgccaaagtacttactgatgactgaccacactgtcttgtgaggaactgggtcccctgcactggatcagagccaaatgcaagccacccatcagttcagaggaagcaggaaaacatcttttgggtggtgcatagaacattgagctcttaaaaacccggagaaaaattaggaatttagaaagtaagtgggaggtagaatattgagtccttttttaaaaaaaagaattgatgtctaaatatgtagtctgaacttaagtgtcctaaaaccttgttttttgtttttttgttttttgaggagtcgtcttgctctatcaccaggtgggagtgcagtggcacaatctcggctcactgtaacctctgcctcctgcctcccgggtccaagcaattcccctgcctcagtctcccaagtaggtgggactacaggcgcacaccaccatgcccagctaacttttgtatttttagtagagacggggtttcaccatgttggccaggatggtctcgatctcttgacctcgtgatccacccatctcggcctcccaaagtgctgggattataggtgtgagccaccgcacccagccaaaccttgatttttttagccacctctgggattgcctgggttccctttggagaagaaactaaaagttatggccatagaaaaagccctggtaagaaaatatttgaatggtgtaagatggtggaaggaaagccatcccacacccctacaacatatgttctggcatttataaactgcttgattgtgtgcctcaaggggagaaaaagtcaagcaatgcttcaaaggccaggctttctaagcaaatgagtggttcaaagcagtgtttggctcaagggcagtctggttttatggatagggccgacccaagacatctgctcatgaagaaatgtggcatctgttgccatttcctaaactataaggtttagatagattgtcttgaattttgatagcaaatttttttaaatttatatttctgcctcctcgtacatccttatatatggaaaaaaaagtaagagttcctcagatcagagctcagtagctgtgtcaatttgaagttcaatcagtgtagttgtcctggggtgatcgctgactctgctctgtttcatatttcagttgcttgctccaaggagagaatttctgagaacaatgggtgttagcaactttaagttactccccaaacgtttgctggccacattctcatttctaaacatctggatctgggtaaaggtttgaatagatgtagggaacaaaattggtttttccatggtgtagtctaattttgccaaatcacccaagaaagaaagtatatgacgtgtggagtttgcatttcttggatgggacctatcgggtcacccagcccagtcttacagtcataaattcctacctcttagttcctgccaaagggccttcagcctctgtgtgcacacttattgaatgaatgctttgcctaaagtttggccttttgaagaaaaacagcatgtgataatataaaaatatgagagtttaaaaaaaaaaaagatctctgcctctcttctctctgcctcgtcccaccttgctgtctgtctcattgtctttctctcccctcaccatgcgctgaattcagatttctctttcttttattataggcatgttgttttgaatgtggactttgtgggagggagaggattgttctgagaacagaaactggaagatacgtctgagttgatgggaccaacagggctttgctcctctgtgagggccaaagccattgatacttgtcgggggtgatgagggctttagcatctcaaggcagacatatgaagtatttactgctaaactatattacttactagtacaaatctgttggaattcaggggcagtctaagatttggtgagtgaaatgccatctggcaaaatcgagaagagagtgtggcctgagaggggaatgttcagcctcactgtcacattaagggtacctcaaaatacatggtccttccagtgtgttccttttccttcctccatttcactttgtcccctcttcttcctttctctcccattttcctggctttttagcactcagcttttttttataagtatgtatttactttttattatatatttggtcctttgggactttgtgatgattaagaatttattccattcaggattttaaaatgatgtgtttaatattttgttctcttaaactcttttgaagctatgctgctaaccaggtataggccagaaaggaggtggcccagtcagtaccttgctcacgtcagctaagggggacagtgatgtcatgtgggtgactcttcttcatttgaccaaggccagcctcctgttcttacctctgcccattcatttctggctatgggaaaactaccacctgttgagtgagccaatgaggccaggaagatcagaggggctgggttccggcccatgggccactatttgaatttctctgtagtaagctctttgtagggctggctccaactgcagtagccaaagaaaacctgtctgactcgacattttaatgcctgagagttggtgaaagttcagctgaagctaatgtctagacatcagcagtaactaggcatccagaaagtagcttcaaccaaagctaatagagcccaagtttccgcaggaagtttggtgctgagctgtccagagcagttgtttatctgagtgttgctagcccttagccatgctttcttagctttattctcgcctgttcctaggcatagcctgaaccagagctatggctcactgctcgctttattctactccctagtcatgcggaacaacatagtctaaaaaggaagatgtggactggggagttaggagacctgatttctattccctatgcttctactaactagcctcgagatcttaaccgctctgtgcctcagtgttcccatctgcaaaatggggatagtgttaattgccctacctacctcacagggttgttgtgaggataaactgagacaatgaattcaaagcaagttgacaagtaagtgctatgcaaattgtaagaaatggaaacaatcatgttaaaagcaatggaatggacattggcagaagggttaatggattgtccagccctttctctgtgtggcttaaacccaggtcgccattgctttatacattttcacttagcacagatttgtaattatgcatgtaataaagcacagccttatccaccctg

SEQ ID NO: 2368 - DNA, 9586 bp, Homo sapiens
attattatttttttttattttatttcccagtttgttgacacctcttacattcacaggcaactgctcaagtgtattgggaaatacagttgtgtattgtgcagttgactggcctgatggtgggggtgctctggctgggatggaatgctgctaggggggctaagatgaagaggagtcaaggatcagctcacaggttagcgagcagccagtccagcaactgtttcctggccacctttcccacagcttcatctggttgccgttccttggcaaacttcatgacctcttgaagaagacctcctacactgtaccccttctctgctgctttagctgaaacctgaggaagctgtggggaaaacagagctagtgtgagttgcgtgatgctttttggaggaaagacctgctggacgaagttctaccacccaaccccctcaacccctaacctcctcacccacacccaccaccttcccgcccatgattctaggattagggtacagcatgtcatagatctaggactagaggctgctgacacatctttccttttcccttgaaacttctctaatgacatagatcaaaatgccaaagatactttcttttttgagcttcaaaaacacactctgaaattagttgtgttcattaaatacttttcaccagatgctggacccttcagttagtctgtgctgattgctaggtcaaggtttggggttgccattcccccacctccctaaaaaagtatgagacttggagtagggacgattgtctgagcttggctcctggactgaaaataactttgttaagtatttgatgtttctggaatccatctaatgcaggaaactcagctgtcagataggtgtgtgtgtgtgtgtgtgtgtgtgtgtgtgtgtgtgtgtgtgagagagagaaagagagagagagagagagagagacagagagagaatgtgcatctatatgaatgtatgaatgctggcctccatggaatctgaggagcagggccaggactagggtcaggcaagtgaggcacctagggcataaaatttaaggagacaggactctcagggcacttgcaggacccatgagtttgggggaggagcatagggaaaatagtaagagacaagtttcaaactgtttctggtaggtcaaacacaaaattagtccatgatacttccaacacctcaagaggtagggaagaactccattttccttttttgttccctcctctctagagtactttgggggatcttaaaactcaaaacataagacttaatcattccccaatgttttatcaaatagtttgtcaaaagggtcacggatgaaatgcgttaatctcactctcctcctcttggtggaaatgcacaggctttgaggtgtccacttagctagtggttcaccgtttttgtgtctttttatgaggtgaaagtaattcatgaagcacacggtaaagaatagacttgaaactcgaatgatcttgggctctaagtacaatgctgcctccctgcctctgcccattccaactttcttcttgtgccttaatgcattacttaccttttccagttgtccatccttatctcccatgaagtagagcatgggcacgttaaactgggaggctgcaatccactgcaggacagcctggagctgcttctgcaagctatttgtagagcactgattattgacaattacttcatgtccaagagagtcttgatagttctgtggcattgcaccactgtgaatgcatctggtgcccctgaaattgggcttatttgccgaggctgcttgttcttccaactcagcaagggctgccccatcgttgctatacttagccatgataaggcagagcttcatcacagattctactagtttatctataaattgcccgttcgcttgcttcatcccactggtacagtcaagttcttgatgctcctggcattgttcttccgctttgtcagatctgttggacatggaagctgctttgcttgccctgggctcagaacacttgttctcaccttcgcatggatcctcacatttgaaggggttctcattaagcagtttctgaatcagcattagaacgatgtttgacatatccattttctgggagtccaggtgttggttctccttttgacaggtggatggtccaggggctctgtgagattctagttgtttcactgaaagtgctttggcactttggccacctccacacttttcatattgagtactctgagccatatagcccatggtggaaccaggacagtcttcttcacatgtatctttgcccttagtctgctgggtcagatggtactggatcagcttaagggcagagacaatcaggtccttggccagtgaatctgtggaagcattgatcttttctcctttctcatctttattgctgcatgctttggtagccaccttgcatgagtttccttgcttttggttccagatggttaggccctctttgagaatgtgttcaccgactttctcagcactagtcagtgacttgcatgggtctgatttcattttgcctttgtccctctctttcatttcagctttcatggtggagaattcaagactctgattcctgcatttgggatcatgggacccagcttttaaagatgcatatgacagactctgagacttagtctccttctcctcacctataagggcactgaccaagcgcttcagcatggcctccatgatgtctgtagcattttgtttccactggttgaacagatttctcttgacagctgagacaaagtctgagtcagtcatcaggaccccagtaatattatgcaggttcttcatgcaagaatcaatcaaatcggacacaatctccttggtgtgccttagcaacaccctcttcaggaccacagatgctggaattggcttcccagagctgtgcactttcaaggtcttcatgagagagaccatcatgtcagatgccacctgatttgcataaaccatgagccccttgctgatggaatctgcaaattctttgctctctctctgggacatctgtttgtctccacttttgctcttgttggataattcgctatatagaaagcttttctggccaccttccctggactcctctccagtgccacgcatttctgcagctgtcagttccacagcttcataggccatttcagaagcaatcttgctcgcaggagttcggggactgattctctctttgttcccaggggatggacagattgaatgatgaaggcatttgcttttaccttccaacttctccttgatttccttatgggccatctggattaccagagaagatagtcggttgacgtagaaggaaaggtcatctatagaacattctccatcaggggaaatgactgctctctgagtgctaggaggtttggctggaggagctgaaggactttgattattgttggtgtttttagctgctgtcatttctagacgtaggttttgaggtctgttcatcaaataatctatgttcacttgatcggcatagacactgtagcagttctcagaggatgctctgtgatattcgccctctgtgtctcctactttatgtttacaggtagaggttgaggggctcagtgcatgttggaaacccaaggcatacttctggagatcactgagaagccagttgaggacacttacaggatcagagggagcttgtttgaaaaggcatacagatccctctgtctaaaaaaagaagaagacctatccataagagtttgggtaggctacttttttcccttattttatttagaagatgtatcagattagggatttgaccttttggagtttgtatgggaacgtaacatccagttatatccattagtacacattcaagcagaagtggcagcaacaaaagttcaaagtatatacatgtgtatactttatagaagggttatcaatatatgtctgccaactcatatgaatatgttgtatctcaatgtgtcaaaaatgtgtcagtgtgtctgttgtgtgtgtatatatgcatggaaatatagcagttcacatgtgtgaacatctcaaagacgtgagaatgtgccattctgtattgttagtgtgtgaaaatgtgcttctgtgtgtgtgtgcatatgtgtgactatgtctaagcatgtgtaataatgtgttgacatcattacctattgtatatgtctactgtataggctgacatgtgcatgttagtatgcatatttgtacatgtgtgaatgtcaaaatatgagtgtctatgtcagtgtgtctctgaatatgtaaatgagcaagtgtcaatttcagtaatctgcatatatgtgtgtaatataaattcactagtatgtatcatgcagctataaatgcatttatgtatgttaaagcataaattcacatattaacatacacattcattaatataatagatacaattttaatatattaatgtatatgtatgttaaaacatgaatatgtgtaaacaggtgattgtataatgactatgtatgttcataaattgggtataaatttatgttatatttatatgttatgtcaatatttgaccatgtgtatgtcaatgttgtacataccctggtatttgagtatgtgtgtgagtaggtgtgttattgcatttgtgtcaacagtgtatgtatcaatacgaacaaacaagtgtgttagtaaatatgtgtcgcttagtgtaagtttgtgtgtatgtcagcatgactgtatatgaccatatatgtctttgcatacatatgtatatttataagtgtgtataccaataactgagtctgtatggtcactatgttttgatcaagtcttatgcatgtaatgtgtgtgaatgtatgttcatgcattgtgtaatatgggtgtttatgtgtgtcctgtgtgggcatgtcactgcatctgactctgtatgactttgtatatctttgtatatgtgtgtcattgtttatgatcagtttaagtttgctacatcaatgcttgtgtatgtcaatatcaaatgtagccaagcatgtatttataattgcttgtataaattgttttttgtaaatgtatataaatgtatacattgatgtgtgtatcattttgtataaatttatatgtgtatacctatgcctgtgactgtgtatgcccatgtccagatatgtgtatatgtactatatacacatattccacccaacactaactaccaagccctctgctccttctattgcttcatctcctctcttttcactgaatttctggaaatgtgaggtcatgataaagtcaactttttgcaaatgagcttaagttacaatcaagcagatctgcattgtatgtaggaaacatgggctgctttttcaaaaattaatgccaggtataatttatccctttcttaagactccaaaattgagttggccatacccaagtaaactgaaaactctttggatactgtaatgtaaacttgtttttccttccttgggggccactcctttctggagtctggggtcagaaataatgttttggttataatatgagcctggagacacagaacaagaaacatttgattcctctgcattaaagtcaaatatcctgccctattaccagccactccaggcttgtaggtatgagagggtgacttgttgtatgctccagtgccctcccaaaaccaggaccctaacagatataattttggatacttaaacaaaaccaaaaggagtttgtatgtcacagtggcatgcaagtttaattgcttctaactttaagctactcaacagcctaggtaatctcttagacaacagggtaaggatgaggcactcaaattcttggtggttatggattgtctctgctccatacccctctttcttccctgctggatgctgggcaatgtggggcacacaagtccattaccagccagcgaagaacattacaaatagtcttgtgtgattatgattggatgggtagctggaaatcaggagagggcattctgagcctctgtgattagtgccattattaagtacctgggtgttgaacttactgtggtcttgaacttacgcctgtgttctctagaatgtcatagtattcaaattgatgagcctgtttgacagtaagtgtcttaccatgtctgatccagagtcctcagactcatcattgagctctgagaattagaagtggtgggatctcagaggttaagtgtaccttagactggtctttcttctcagtgtccttgatcacgataatctctttttcttccagacttcccaggtttaagttgccttctgagctggaactagcagcatcctatggaattaaagggtgagattcttaaacagttacttttggatatttctccaagctgcccccctaggctatgacttcaaatcatgaatgttatgacttcttttatcttttttctttctgcaggagaggtaggcttgtgaggctagctaatctttgaagaatgagacgaagttccctccacaaattactactccccactctgaagatgctcacaaagccaccagtctcaagaactatattcatcaccctttggatgggtttttttttttaaataaaaaaataaaaaacaacttttctgacatgctatcttccatgttttatctctttcagtcctaccagcaacttaagtggcttctaaaatgagacttgatatcaagagtgacggtaaattcagaaccagggatcttgggctcatgagaatgctggctttccccctgagtcccctcctcctttcccctctctccccccaacattttccattcttcatacttcactgataacccttctcagcagcttcccaccgattctgactctgagcagagaatacgcaccttgtaatctttatcttctacattcagggtggacacatcgacaaagcatatctgcatcaaattagaagggtgaatttagaaaaactctagagaaaggggcataatttctctttcttggagatgataatagcacctacctcagagggttcttgtgaggattaactgagatactatatggaaagcatgtaaaagcagattgcctggcacatagtgagtacccaataaatgttaatactgtgattattgttaggcagacagaatcttagcattagcacatttcttaaatgagaataccaacctcctgtcagagtgaggcctgaggtacaatatccacatgtattaattgagaaaactgtgaagagaaatggcttgcccaactgacacaaacttaaatgtggagcttgtattagaactcaattttcctggcttccagtttagagcacttgctactacactagtgtttctcaaaatttattttattatcaataatatagaatattttaagtagtgtatggataaatatttctgcatttaataggtgaattttattgtgcattagggagaatacatactagaacatcaaacctgggatattatggataatatttcttagcatgattgtaatttttaaaatgtaagtcaatttttaaaacattgtaaaaatacatattaattaaataatagtatgcgtgacatttgaacatgattgaagactgtgaagccctgtgaattacttgaagtttgggaaacagaccatgaagcattttgccctcctgaggggtcctagggtaacattgttagctaggcaatattattatgacttaagaggtcttaactaatagaggctggttgccaggcaaccaccactcctccctcaggctcctccccagcctcccctccccaggtcctttacatcacaccacaccctgcccctcccttgatttttatctctgtgtgatgtatgagcatgctggcccctgacagaccttgttgagcttggttgcttggagaagtcagggtatcatcgtccattagtttatcttgggccccaggatatctatacccatatgccaatttttcctactcctcggcatgagtcattttttatcttaccactttccggtcctgatcttgctgtccttctgggttgtagagatctaccttgcacacacccctgtggctgcgtaaccagtcaatatcatcagacatctggaaagagaaagaaaagaaagctgaaatgcttatatatggtttttggaaaccgggtcaatttggataagaatctctggaggggttctgaaatccatttctgtgtttcatatataggtttaggctaggaactggtggggtgagcagtgggggacacattgagatgtttgaacttgatgcttaggatcattatcttttagcaaaatccatagtctcctttaatttagactccccacaccaagtatttggaatcatgagagtatgatgacctgggaatcaaatttaaaaggaaatctagtgactttggggattacatttagtgatttacttctacccaactctactaactaaatgtctctgatctccacatttctttaccccctcgagtaccttcaaaaaactccagctcacgttaccccctctaacttaattctagctaactccagttcaaccagtctttcccattacactaaagaaagtgaaattagataaatagctataacacatcactcagagccattggaaaatactaaagtcaatagcagtaaataaatagcccttttattaaaacaacatatacaatttcaatatatagaacaagattttgaatgctgagaaaacccagtctaataaccataaatataacaccgagagacagaaatctgagggaagaccagaccctgatccaataggatcaagtttaatttattttagaaagaaaaaataatctctgccaacttccttccaccatcaccccctgccaccacctcccaacccagtctggaactaaaagtaaaaaggaaatgacaaaagccagtgactgatttttgctacgtaagacctgagatttatgcttagaacacacagttaagagctcagtagacttgtttttggtatctggggcttgaatttgatttctttttaaattttaacaagagaaatcctttttgccaagtattagagggctattgaattccccctcccaccctccccactcccgctctcccttctgcccttcccctcccctctctccccactcccctccctccctcccctttccattccctccccctttctccccctcccctttctcccccttccctccccctccctccccttctctttctccctccttctttccttccaccccttctctattcccctacagcatattaataatagctattctctaatggctatcctttcacatgataatactacattcctgctctttaccatccctgcctccaaccaagatctttttgaactcttccttcaggaatctctgtgaaaccttgaaaaagttataggaaaagactcactctgaagagggagtttctttttttccaagagctacatagggaacactagcctagtaaaaaaagaggtggaggcatagagtccctcatgtgattcagaaacagcctaagtccaagtccaaaagaactgtgaaaaataaaatttatgaactcattaccttgatgatgaagttcttttagatgtttggctgaaaacgtgacacccagaagggagatgtgcccctttagatggaactgagaagtgccaagttcttgggcacctgcagttggctgccacccctg

SEQ ID NO: 2369 - DNA, 10255 bp, Homo sapiens
gacacatttattattatttttttttattttatttcccagtttgttgacacctcttacattcacaggcaactgctcaagtgtattgggaaatacagttgtgtattgtgcagttgactggcctgatggtgggggtgctctggctgggatggaatgctgctaggggggctaagatgaagaggagtcaaggatcagctcacaggttagcgagcagccagtccagcaactgtttcctggccacctttcccacagcttcatctggttgccgttccttggcaaacttcatgacctcttgaagaagacctcctacactgtaccccttctctgctgctttagctgaaacctgaggaagctgtggggaaaacagagctagtgtgagttgcgtgatgctttttggaggaaagacctgctggacgaagttctaccacccaaccccctcaacccctaacctcctcacccacacccaccaccttcccgcccatgattctaggattagggtacagcatgtcatagatctaggactagaggctgctgacacatctttccttttcccttgaaacttctctaatgacatagatcaaaatgccaaagatactttcttttttgagcttcaaaaacacactctgaaattagttgtgttcattaaatacttttcaccagatgctggacccttcagttagtctgtgctgattgctaggtcaaggtttggggttgccattcccccacctccctaaaaaagtatgagacttggagtagggacgattgtctgagcttggctcctggactgaaaataactttgttaagtatttgatgtttctggaatccatctaatgcaggaaactcagctgtcagataggtgtgtgtgtgtgtgtgtgtgtgtgtgtgtgtgtgtgtgtgtgagagagagaaagagagagagagagagagagagacagagagagaatgtgcatctatatgaatgtatgaatgctggcctccatggaatctgaggagcagggccaggactagggtcaggcaagtgaggcacctagggcataaaatttaaggagacaggactctcagggcacttgcaggacccatgagtttgggggaggagcatagggaaaatagtaagagacaagtttcaaactgtttctggtaggtcaaacacaaaattagtccatgatacttccaacacctcaagaggtagggaagaactccattttccttttttgttccctcctctctagagtactttgggggatcttaaaactcaaaacataagacttaatcattccccaatgttttatcaaatagtttgtcaaaagggtcacggatgaaatgcgttaatctcactctcctcctcttggtggaaatgcacaggctttgaggtgtccacttagctagtggttcaccgtttttgtgtctttttatgaggtgaaagtaattcatgaagcacacggtaaagaatagacttgaaactcgaatgatcttgggctctaagtacaatgctgcctccctgcctctgcccattccaactttcttcttgtgccttaatgcattacttaccttttccagttgtccatccttatctcccatgaagtagagcatgggcacgttaaactgggaggctgcaatccactgcaggacagcctggagctgcttctgcaagctatttgtagagcactgattattgacaattacttcatgtccaagagagtcttgatagttctgtggcattgcaccactgtgaatgcatctggtgcccctgaaattgggcttatttgccgaggctgcttgttcttccaactcagcaagggctgccccatcgttgctatacttagccatgataaggcagagcttcatcacagattctactagtttatctataaattgcccgttcgcttgcttcatcccactggtacagtcaagttcttgatgctcctggcattgttcttccgctttgtcagatctgttggacatggaagctgctttgcttgccctgggctcagaacacttgttctcaccttcgcatggatcctcacatttgaaggggttctcattaagcagtttctgaatcagcattagaacgatgtttgacatatccattttctgggagtccaggtgttggttctccttttgacaggtggatggtccaggggctctgtgagattctagttgtttcactgaaagtgctttggcactttggccacctccacacttttcatattgagtactctgagccatatagcccatggtggaaccaggacagtcttcttcacatgtatctttgcccttagtctgctgggtcagatggtactggatcagcttaagggcagagacaatcaggtccttggccagtgaatctgtggaagcattgatcttttctcctttctcatctttattgctgcatgctttggtagccaccttgcatgagtttccttgcttttggttccagatggttaggccctctttgagaatgtgttcaccgactttctcagcactagtcagtgacttgcatgggtctgatttcattttgcctttgtccctctctttcatttcagctttcatggtggagaattcaagactctgattcctgcatttgggatcatgggacccagcttttaaagatgcatatgacagactctgagacttagtctccttctcctcacctataagggcactgaccaagcgcttcagcatggcctccatgatgtctgtagcattttgtttccactggttgaacagatttctcttgacagctgagacaaagtctgagtcagtcatcaggaccccagtaatattatgcaggttcttcatgcaagaatcaatcaaatcggacacaatctccttggtgtgccttagcaacaccctcttcaggaccacagatgctggaattggcttcccagagctgtgcactttcaaggtcttcatgagagagaccatcatgtcagatgccacctgatttgcataaaccatgagccccttgctgatggaatctgcaaattctttgctctctctctgggacatctgtttgtctccacttttgctcttgttggataattcgctatatagaaagcttttctggccaccttccctggactcctctccagtgccacgcatttctgcagctgtcagttccacagcttcataggccatttcagaagcaatcttgctcgcaggagttcggggactgattctctctttgttcccaggggatggacagattgaatgatgaaggcatttgcttttaccttccaacttctccttgatttccttatgggccatctggattaccagagaagatagtcggttgacgtagaaggaaaggtcatctatagaacattctccatcaggggaaatgactgctctctgagtgctaggaggtttggctggaggagctgaaggactttgattattgttggtgtttttagctgctgtcatttctagacgtaggttttgaggtctgttcatcaaataatctatgttcacttgatcggcatagacactgtagcagttctcagaggatgctctgtgatattcgccctctgtgtctcctactttatgtttacaggtagaggttgaggggctcagtgcatgttggaaacccaaggcatacttctggagatcactgagaagccagttgaggacacttacaggatcagagggagcttgtttgaaaaggcatacagatccctctgtctaaaaaaagaagaagacctatccataagagtttgggtaggctacttttttcccttattttatttagaagatgtatcagattagggatttgaccttttggagtttgtatgggaacgtaacatccagttatatccattagtacacattcaagcagaagtggcagcaacaaaagttcaaagtatatacatgtgtatactttatagaagggttatcaatatatgtctgccaactcatatgaatatgttgtatctcaatgtgtcaaaaatgtgtcagtgtgtctgttgtgtgtgtatatatgcatggaaatatagcagttcacatgtgtgaacatctcaaagacgtgagaatgtgccattctgtattgttagtgtgtgaaaatgtgcttctgtgtgtgtgtgcatatgtgtgactatgtctaagcatgtgtaataatgtgttgacatcattacctattgtatatgtctactgtataggctgacatgtgcatgttagtatgcatatttgtacatgtgtgaatgtcaaaatatgagtgtctatgtcagtgtgtctctgaatatgtaaatgagcaagtgtcaatttcagtaatctgcatatatgtgtgtaatataaattcactagtatgtatcatgcagctataaatgcatttatgtatgttaaagcataaattcacatattaacatacacattcattaatataatagatacaattttaatatattaatgtatatgtatgttaaaacatgaatatgtgtaaacaggtgattgtataatgactatgtatgttcataaattgggtataaatttatgttatatttatatgttatgtcaatatttgaccatgtgtatgtcaatgttgtacataccctggtatttgagtatgtgtgtgagtaggtgtgttattgcatttgtgtcaacagtgtatgtatcaatacgaacaaacaagtgtgttagtaaatatgtgtcgcttagtgtaagtttgtgtgtatgtcagcatgactgtatatgaccatatatgtctttgcatacatatgtatatttataagtgtgtataccaataactgagtctgtatggtcactatgttttgatcaagtcttatgcatgtaatgtgtgtgaatgtatgttcatgcattgtgtaatatgggtgtttatgtgtgtcctgtgtgggcatgtcactgcatctgactctgtatgactttgtatatctttgtatatgtgtgtcattgtttatgatcagtttaagtttgctacatcaatgcttgtgtatgtcaatatcaaatgtagccaagcatgtatttataattgcttgtataaattgttttttgtaaatgtatataaatgtatacattgatgtgtgtatcattttgtataaatttatatgtgtatacctatgcctgtgactgtgtatgcccatgtccagatatgtgtatatgtactatatacacatattccacccaacactaactaccaagccctctgctccttctattgcttcatctcctctcttttcactgaatttctggaaatgtgaggtcatgataaagtcaactttttgcaaatgagcttaagttacaatcaagcagatctgcattgtatgtaggaaacatgggctgctttttcaaaaattaatgccaggtataatttatccctttcttaagactccaaaattgagttggccatacccaagtaaactgaaaactctttggatactgtaatgtaaacttgtttttccttccttgggggccactcctttctggagtctggggtcagaaataatgttttggttataatatgagcctggagacacagaacaagaaacatttgattcctctgcattaaagtcaaatatcctgccctattaccagccactccaggcttgtaggtatgagagggtgacttgttgtatgctccagtgccctcccaaaaccaggaccctaacagatataattttggatacttaaacaaaaccaaaaggagtttgtatgtcacagtggcatgcaagtttaattgcttctaactttaagctactcaacagcctaggtaatctcttagacaacagggtaaggatgaggcactcaaattcttggtggttatggattgtctctgctccatacccctctttcttccctgctggatgctgggcaatgtggggcacacaagtccattaccagccagcgaagaacattacaaatagtcttgtgtgattatgattggatgggtagctggaaatcaggagagggcattctgagcctctgtgattagtgccattattaagtacctgggtgttgaacttactgtggtcttgaacttacgcctgtgttctctagaatgtcatagtattcaaattgatgagcctgtttgacagtaagtgtcttaccatgtctgatccagagtcctcagactcatcattgagctctgagaattagaagtggtgggatctcagaggttaagtgtaccttagactggtctttcttctcagtgtccttgatcacgataatctctttttcttccagacttcccaggtttaagttgccttctgagctggaactagcagcatcctatggaattaaagggtgagattcttaaacagttacttttggatatttctccaagctgcccccctaggctatgacttcaaatcatgaatgttatgacttcttttatcttttttctttctgcaggagaggtaggcttgtgaggctagctaatctttgaagaatgagacgaagttccctccacaaattactactccccactctgaagatgctcacaaagccaccagtctcaagaactatattcatcaccctttggatgggtttttttttttaaataaaaaaataaaaaacaacttttctgacatgctatcttccatgttttatctctttcagtcctaccagcaacttaagtggcttctaaaatgagacttgatatcaagagtgacggtaaattcagaaccagggatcttgggctcatgagaatgctggctttccccctgagtcccctcctcctttcccctctctccccccaacattttccattcttcatacttcactgataacccttctcagcagcttcccaccgattctgactctgagcagagaatacgcaccttgtaatctttatcttctacattcagggtggacacatcgacaaagcatatctgcatcaaattagaagggtgaatttagaaaaactctagagaaaggggcataatttctctttcttggagatgataatagcacctacctcagagggttcttgtgaggattaactgagatactatatggaaagcatgtaaaagcagattgcctggcacatagtgagtacccaataaatgttaatactgtgattattgttaggcagacagaatcttagcattagcacatttcttaaatgagaataccaacctcctgtcagagtgaggcctgaggtacaatatccacatgtattaattgagaaaactgtgaagagaaatggcttgcccaactgacacaaacttaaatgtggagcttgtattagaactcaattttcctggcttccagtttagagcacttgctactacactagtgtttctcaaaatttattttattatcaataatatagaatattttaagtagtgtatggataaatatttctgcatttaataggtgaattttattgtgcattagggagaatacatactagaacatcaaacctgggatattatggataatatttcttagcatgattgtaatttttaaaatgtaagtcaatttttaaaacattgtaaaaatacatattaattaaataatagtatgcgtgacatttgaacatgattgaagactgtgaagccctgtgaattacttgaagtttgggaaacagaccatgaagcattttgccctcctgaggggtcctagggtaacattgttagctaggcaatattattatgacttaagaggtcttaactaatagaggctggttgccaggcaaccaccactcctccctcaggctcctccccagcctcccctccccaggtcctttacatcacaccacaccctgcccctcccttgatttttatctctgtgtgatgtatgagcatgctggcccctgacagaccttgttgagcttggttgcttggagaagtcagggtatcatcgtccattagtttatcttgggccccaggatatctatacccatatgccaatttttcctactcctcggcatgagtcattttttatcttaccactttccggtcctgatcttgctgtccttctgggttgtagagatctaccttgcacacacccctgtggctgcgtaaccagtcaatatcatcagacatctggaaagagaaagaaaagaaagctgaaatgcttatatatggtttttggaaaccgggtcaatttggataagaatctctggaggggttctgaaatccatttctgtgtttcatatataggtttaggctaggaactggtggggtgagcagtgggggacacattgagatgtttgaacttgatgcttaggatcattatcttttagcaaaatccatagtctcctttaatttagactccccacaccaagtatttggaatcatgagagtatgatgacctgggaatcaaatttaaaaggaaatctagtgactttggggattacatttagtgatttacttctacccaactctactaactaaatgtctctgatctccacatttctttaccccctcgagtaccttcaaaaaactccagctcacgttaccccctctaacttaattctagctaactccagttcaaccagtctttcccattacactaaagaaagtgaaattagataaatagctataacacatcactcagagccattggaaaatactaaagtcaatagcagtaaataaatagcccttttattaaaacaacatatacaatttcaatatatagaacaagattttgaatgctgagaaaacccagtctaataaccataaatataacaccgagagacagaaatctgagggaagaccagaccctgatccaataggatcaagtttaatttattttagaaagaaaaaataatctctgccaacttccttccaccatcaccccctgccaccacctcccaacccagtctggaactaaaagtaaaaaggaaatgacaaaagccagtgactgatttttgctacgtaagacctgagatttatgcttagaacacacagttaagagctcagtagacttgtttttggtatctggggcttgaatttgatttctttttaaattttaacaagagaaatcctttttgccaagtattagagggctattgaattccccctcccaccctccccactcccgctctcccttctgcccttcccctcccctctctccccactcccctccctccctcccctttccattccctccccctttctccccctcccctttctcccccttccctccccctccctccccttctctttctccctccttctttccttccaccccttctctattcccctacagcatattaataatagctattctctaatggctatcctttcacatgataatactacattcctgctctttaccatccctgcctccaaccaagatctttttgaactcttccttcaggaatctctgtgaaaccttgaaaaagttataggaaaagactcactctgaagagggagtttctttttttccaagagctacatagggaacactagcctagtaaaaaaagaggtggaggcatagagtccctcatgtgattcagaaacagcctaagtccaagtccaaaagaactgtgaaaaataaaatttatgaactcattaccttgatgatgaagttcttttagatgtttggctgaaaacgtgacacccagaagggagatgtgcccctttagatggaactgagaagtgccaagttcttgggcacctgcagttggctgccacccctgtcagctgttggaccagactgaggggccaggctttcccctgctgcctctgaccctggggtgtggcaacagagtttgttgggtcacaatgcctgaactgtcacaacctaagcaaaggtgggcatgttggcaaactcagaaacctattcccatcaaaagcacatcaggctgcctgtggtgcgacaaactttttctgttatctctatgagggtacacaccatttttctcacattttctctggctcacagtccatcaagatatcccttctcttttcatttcctgcgagacctccagaacaatctaatcatacccctactagagaatcagagttatattgcaagagatctttagatttacgtagaaacagagaaatgttgatcaaaatcttttctgggtatcccaaataaaagtatgaaaatagaaacttggaggctgcctcagcagcttctgtagtttcacctcaccattaagatgcccccttagctagtcaaaaagaagtcagatgtccctaccattgtagtatcagagtacgccatcatgtaggaccctggaatgatgttttcttgttgatttggatgctgtgatgactcttccagtctgcctcaagatactgcttttttcttcaactctccatgccctcctacagccttgactgccagctgg

SEQ ID NO: 2370 - DNA, 5908 bp, Homo sapiens
gtcccttgggcttgtgttggggcctgttgttgaacactaagcctttcaagatggtcctcctcagtattcttagaattctttttctttgtgaactcgtgcttttcatggaacacagggcccaaatggcagaaggagggcagtcctctattgcccttctggctgaggcccctactttgcccctgattgaggagctgctagaagaatcccctggcgaacagccaaggaagccccggctcctagggcattcactgcggtacatgctggagttgtaccggcgttcagctgactcgcatgggcaccctagagagaaccgcaccattggggccaccatggtgaggctggtgaagcccttgaccaatgtggcaaggcctcacagaggtgagttgttatgcccccatactgccctggaagggagagaagtggagaggagtgtagagaaaagggaattggtgggtttactgtcaggctttgttgccttgtgggcaggttgtttctttaggcttggttttcaaaggatggcaagctttggagaagccagcgccaagcctacttccctttagggcatcaacttaagaacagattgccttggtgcctactgagaaatctttcccaggccccaggacaactgagtgatgtgccatcacctatctttcacagaaacttttattgcttgtgatagttctgaaaactgtagagacatatccagctatattcttgtggagggctatttaagtggcgttttgctcttagagtacagcttgctgagttggggaaacttataaggcctcagaaaggacataaataagcttacatctgagggtctgtatacctggctctgtgaacatgtgctactgtatttcttaatgaaagctactatcttaactgtcttgatgcaattagcctaattttaaaactaaggcacggagaggttaagtaacttgcaaatggtacacagatagtgggtcgcagagatgggattgcagctgaagtctgtctgattctaaagtctgtcggtaacttcttaagtctttaaatgcagtattccaatatccttgtacccccaatagtttttctacttgggccatattgctactttgggattctgggactaagtgtattttggaacttttttttgtccccatcatgcttgattttgcttttaacatttgcatcagacattgttgcaggacaacagtgggctattgaagtgtaggactctctagagaatgcagacagtcatcaacttcaaggaattcttgggaacctagtgagatcaatctgtagccttcactagtctgagatgaaaagggacaggacttaatcccctccccaagcaaaacaataaatattctcgtacctaacccttactgtgagattactgtgtgccaggcattgcacaaaatgttttataaacattatcttaatcctcacaactaccagattaggtagtattaacatgcctacttgataggtgaagaaactgaggatcagagtcacttacccatgtcatacaaccagtaattgctagagccaggtatcaaacccaggctctcaggcccaaagcctgtgtgttaatcatcttgctgttctgactccccactggattttaattgagtgccaggcagtgtgtttgggttgggtatatagaagcaaatacttttccgacctctagaagttcccagtatagtggaatggatagataattacataataatgttacagtatgccaagtgctttggaaaggacaaacagtagggctcccaggacctatgagaagaaatggctcatttcttgaagtgaagagactgttggaaggcctcatggaggaggtagtacttgaaactgaccttgcagaaggagcaaagaggtcatgcattgaggcagataagtgcattctgatttaggaaagagaaaatggtgtgggtagagattcattgaacaaatattaggtgccaaatgttggcacctactgagtactaggcatacagatgtgatcaagataggtaaaacccctactttcatggaacatatgttctcgtaggggagacaaataagcacacacagttaaattgtgaattgtggtaagtgctatcaaaggatgaagtaggttgttaagatagagaatggcaatgaaaccttccctttccatggacttgtcagggaatgtatctttgaagaagtgccatttgagctcaggtctataagataaactaggcatgagaagagtagggagaagcctgatttaggcagaggaacaacaggtgcaaatgcctagagggtgaaaacaagttggttccaattgaagaacagaggaaaatcagtatggctggatcctcatgagcattgtgggaaatggcagggtatgaggctaatgagaagcagggacttgtaggctgtgataagggatctggatcctaagagcagcagaaagttgcaaaaaatcaagcactttgggaggccaatatgggaagatcacttgagcccaggagactgagaccagcctgagcaacacagggagacatgtctctacaaaaaataaaaatacattagctgggtgtagtggtgcacacctgtggtcccagctactcacgaggctgagaccagaggatcatttgagcctgggaggttgagactagaggaacatttgagcctgggaggttgagattgcagtgaggcatgattgtgccactgcactccagcctgggtgacagtgaggccctgtctcaaggaaaaaaaacaacaaccccacaaattaagaaaaaattaggcttgtacagatgatgtgaggctagaaaggaggatgcctagaattagacatgtatcctggtctcactgtggaatatactggtatctagggactgtggaaaggatccagagacagatgacaggttcaatcacacaggatgtgtgattcagccctttccctgaaaagctttgaccagacccttcctggctctgattcttagcaaccccatcctgcttcaggaaacatgtgatgtcaaggtctcaaagaaaagggcagttcctccccagacagcctgctagaggtttgggttgagttcctttatagccagggtggagcaggtttaagggtgggcctctaagaaagattactgtaagatgggagtgtggaataacttgagaaagcaaatacaagcctggcttggatttgtgtgaataatgtctagtgcgccaagcccaagggtatattaagcatgagttggaatttgaccttttattttacttatttttttgagatggagtttcgctcttatcatccaggctggagtgcagtggcacaaactcggctcactacaacctctgcctcccgggtgcacgccattctcctgcctcagcctcccgagtagctgggattacaggtgcctgccaccacgcccggctaattttttgtatttttagtagaggcagggtgtcaccatgttggccaggctggtctcaaactcctgacctcaggtgatccgcccgcctcagactcccaaagtgctgggattagaggcgtgagccaccgcgcccagccggaatttgaacttttaaagatattctggggctgggtgcagtggctcaaagggcggctaatccctgcactttgggaggccaaagggggcagatcgcttgaacccaggagttcgagaccagcccggcaacatggcaaaaccctgtctctacaaaaaacaaaacagaaaaagctgggcatgttggcacatacctgtagtccttgctatccatgggggctgaggtgagaggatctcttgaacctgggaagtcaaggctgtagtgagccatgattgtgccactgtactccagcctgggtgacagagggagactctggaaaaaaaaattctggaacatcaagatgtaaaagaacttctgtgttaaaaatgccacatctaatgaagaattccaggcttgtggattcagtggagaagaaggactaggtgaataaatacaaattaacatggaattatttactgataagatgtctgaagatgagaggtggctttttcctgtggtgccaggcttttgtaatctttgctcttgaccttcgccgggagggggtgcagaagtttggagcaccatggatgtaacctttcaatcctttggccgttgagtgtcagcactacagtttggattaaagctcttattcacaaagcagcatccagcttttagtagacttctcagcaaacaaaatatttatgtgatcaagactgtgttgaaaatagtatatagaggaatagtggtaaaatgaatggggtaaatggagaacaatttccagcaaggagtggtaaagagagagattaagggccaaaggaggaaaagatgcttaagaagcaattcttgaagtagatggaaggcagaagtggtaagatagctgtctgtactagaggatgatagacaaaattattttgtagtgccttggtcctgagtttgaaattatagcaggccatagcacccaatactgaattgttgtcccaaagctgcatctgtatagtgatatgacatgagactctttcttaatccatgtatgtttcaacaattctaaatggacacatttaatggtcaactaataataatattgatcttctcccctacatacagtatgcacacaagataattctatatttgagttttttcccccgagcccagcactgtaagtaatctaacagtgagacagtttctcttaagaaaaacagacttgggttcaaatcttaactctaccacataccagctgtgtgtcctttgtcatagcttctctgagcctcaatttccttatctgcaaaatggggataataactatctcataagactattaagaattaaagagctaatacatgtaaagcatctagtgtattagtaagtgctcagtaaatgatagtatcattatcttgagttaattttagggctgattatagctatcagtctatatcaagacagtttatgaggaatattcatgttaagaggtaagaagctaaacctctgctcttgttccctcttacttctgcaggtacctggcatatacagatcctgggctttcctctcagaccaaaccgaggactataccaactagttagagccactgtggtttaccgccatcatctccaactaactcgcttcaatctctcctgccatgtggagccctgggtgcagaaaaacccaaccaaccacttcccttcctcagaaggagattcctcaaaaccttccctgatgtctaacgcttggaaagagatggatatcacacaacttgttcagcaaaggttctggaataacaagggacacaggatcctacgactccgttttatgtgtcagcagcaaaaagatagtggtggtcttgagctctggcatggcacttcatccttggacattgccttcttgttactctatttcaatgatactcataaaagcattcggaaggctaaatttcttcccaggggcatggaggagttcatggaaagggaatctcttctccggagaacccgacaagcagatggtatctcagctgaggttactgcctcttcctcaaaacatagcgggcctgaaaataaccagtgttccctccaccctttccaaatcagcttccgccagctgggttgggatcactggatcattgctccccctttctacaccccaaactactgtaaaggaacttgtctccgagtactacgcgatggtctcaattcccccaatcacgccattattcagaaccttatcaatcagttggtggaccagagtgtcccccggccctcctgtgtcccgtataagtatgttccaattagtgtccttatgattgaggcaaatgggagtattttgtacaaggagtatgagggtatgattgctgagtcttgtacatgcagatgacagcaacagtacggctagatcaggtttcccagga

SEQ ID NO: 2371 - DNA, 5296 bp, Homo sapiens
atgagtaagccagaatggttgatagtgggggaggatgatgacgacgctgcctttgcccctgtcttgtgtgaaacaactgcctgtgggtttcctgcagcgcagtggggagtgagaggagaaacgtcctgccgtgccacagtgagtttgggtcaaaggcacacatggaggcagtcttggccaaagtcacaatgcggtgaatttcgctgtgcgccaaggaggttcctggccccaggagtgcgaagcgcctgcgcagtgggccccaggcgttgcgcgctgcgggagccaggagacccccgcccctggcccctcgccccggttcctcgcccctcagcccacgccctcccctgcgaacgcgcacgtgaacgggagcgcggacgcgcccgagaatgcgcttcacctcgcagaagcgggtgggctctgtggagagtcgcgggctcgcgggcagcagcgcctcctccactccggcgggcccgggttcggccggccgcccatcggactggcggactggctgactgacacgcctcgcttgcccccgcctccgcccgtgccccgcccagcttcatctctccctccgctccccgggctcgggggcagacggcagacggaggcgcctctctctccccgcccctctcctcggccctttctcttcccagcacctcggctgctgcccggcagcggcagcagctgcgtcggcggcccacacagcagcgagaggcgagaggaggctgcctcgaggatgaagtgcaaacccaaccagacacggacctacgaccccgaggggttcaagaagcgggcggcgtgcctgtgcttccggagcgagcgcgaggacgaggtcctgttagtgagtagcagccggtacccggaccgctggatcgtgccgggcgggggcatggagcccgaggaggagccgggcggtgcggcggtccgagaggtgtacgaagaggcgggagtcaaggggaagttaggccggctcctgggcgtcttcgaacagaaccaggaccccaagcacagaacgtacgtgtatgtactgactgtcacggagctgctggaggattgggaagattcggttagcattgggaggaagcgagagtggttcaaagtcgaagatgccatcaaggttctccagtgccacaagcccgtgcacgccgaatatctggagaaactaaagctgggcggttccccaaccaatggaaactccatggccccatcctcgccagatagcgatccctagtatgtaccgcttgcgcccgcacagacttctgtttgtctgccttgcttaaaatgcatcccgcctggagcacctctcgtaccatgtgcggtctcatgggcaggagggaggcttttgtttccttggcagaccctctgaatcacgcttgcaaactgttgccaggccctgttttcagttggcacgtttttcagttgctttcaaaatcgcttcttggttaccctgtaaaatgtttcggagaagcctatgccgcttggggttttaggtgctgtaactgttcaccctgcttttgggcggggggggggggggtggggggcgaggggtgggcggggagtgtgtgtgtctgcctgtgcgccctgtgatgtttttggttcttttatatttcacacatattcgtgggtgcgtgcacatttttgataccagccttgtggtttgtttggtagtggaggcctttaaagtctgaccagcttggttgtgtggcatcttttagtatttttttcccttgagttgttttctccttcacagcgttcgcccttgttgtcagggaggccttctgtggtgggagttggtttaaaaaatcagttttgaattcgtaaaaacattaggaaatcctacatcttgtgctctttctgcactcgacagtcgctctagcctctgaagtggtatctcatttgcccctttcagaaatttctttttctatttctatgtaggtcatttggttttcaaaaaattttcacaagtaatttttcactgctgactttaaatcgctatttcccatgtagattaaccttactgaatagatgctgctggggatctgctagccaaacgcatctgatcagaaaaactgtattcacagaatttgatttcccatactcaacttccaactcccattgccccttactggataccatagaagaaccatggttctctggatttaagtttgtttttgaaagaaagtggtttccattccatatttgaatgtagtgacattccgcttaacctccctgactcccagtaaccacaggaatggaatcttttgtggtgattacatcccaacagagttagctctagcgatgttcagctggtacagaattgtcaaactattaggattcctgaacaatctctcaatgatagagagtaattgttttgtctcacagtaccaccttttctgggtgccaaattaaaagctctcacgtttgcctcagtacttgcttgaagtcaggaatcccatctagaatagctaaatctctcttctggaccttccgctgttcccccagccatgtctgacattaggtagaaggaaaacctattttgtgaagagggtattcgaatgaaaagatcattcctaatttctagagcaacctagactatgtcatatctcttaaacattattgacaggtattggggtcccttaacttttttttttgagatggagtcttgttctatgggtcactgttacgcactttctattaagaaattttgggtttcgctatgtaaattctaggttcctcttctggatttcatctcccatgacagttgaggaaatgtctagtttttgaagagagtatgggtgggggctgggggaccgggcgcggtggctcacgcctgtaatcccagcactttggaaggccgaggcgggcagataacgaggttaggagatcaagatcagcctggccagcatggtgaaaccccgtctctactaaaaatacaaaaactagctgggcatcgtggtgtgcgcctgtaatcccagctactcgggaggctgaggtaggagaatcgcttgatcccgggaggcggaggttgcagcgagccgagatcgtgccactgcactccagcctgggcgaccgtctcaaaaaaaaaaaaaaaaaaaaaagactgattttccccctcgtccctgtcccccaatggacaagtgcctactttttcttattctaaaaaaaatttgaagacgacatgttggagtaaaggtaagtttggttgcttgatacagaatttgctctggatggttaacatattttctaagaaacctatgttctgttgatcaggtcacctttgaaagaagtaaccctgaaaggggtgaaaggtggccataaatatttttaagtcctgtagaaaattgataaaaattgaagtgtgtatgtgtaagagcttgtaaagaaacagcaacattagagggcccttgtgggatagatggtttaaagggctctgatgctggagctgctccttgtctcacttgcctttaagtggagttcaattgtaagaaaaagcatgtcctccctccatagttgttgactgggaaaagggagattagagcttacagcactaacagctggccagagttttatttttcagagttccttttgtggaagcatcagtcaaaacaaatattctcagcatcattcttgtattgcaatcatctttctgaatgactgttggcctattagaatatggactttttgaggactaggacccagactgaatcctcccccatatcctcagagcctagaacagtgcctgaaatttggagacatttgtctttgatccacagattagaaatgtctacaagtgtattcccgatttctgagcttcataatgtacctgggacaatctgttattccctcaggctctcatctggcctcacagtgaaactgcattcgataattcactgaaggcttttccaattcaaaatggttgatgagccatagtaggtgctcaataagtatttgttgattagaggaatggatgaaccaataaaaccctattaataagaatttttctttttaggtgaatggcatagatgttgttcagatttactttgaaagaatcaagtatgtgaatggatggatgaatggaattgtgaagcacagatgagctctttcacactccaaggacacagctcatcctatgcttttggacacttcttccctgtttattacaatgactattctccaggttgttgcactaccgctgtatctgtacataattctaacttggcacctgtggccttttttgtgctcttatgtgtctgtatttcccggcagagtatacgcccttgaatgccaggaacttgtttccttagtcttttttatatatctagcatataagatattgcttagaatatggtagacatcactgaagatttgtttcagtagttcatattttgtaatgatactgaatggttaaacaatccctttctaatctgtctagcatatatgtgacttttgtttatcaagtgtcacacaactgcttcaaggcagctgtgagatactagaaagcaaaaattcttactcctatgtctgtgtcatcccagatgtgtgcctccagatggcagtatactacactatctgtaaaatatatttgcaaagccaggcacagtgttacgcgtctgcctcaggaggctgaggcagaagaatagcttgagcccaggagctttagtctagcctgagcaatataatgagactccgtctcttaaaatatttgcccaaacattgaacctaaatttgaccatgcccctagaaataattcctaatctttagaaaatagggcagagaaacattattttacaccatggagatgagatcagcagaatccagactataagaaactacaggacacatgacctagtttcttctgtaaataacttgcaaggatgaaagatggaggatgaacctatagatttaaagagacttaagagacatattaaccaattgttaattggatcttatttgaattgtgatttgaccgaactgtaaaacgaatacatttatgagacaatcggggtaatttgaacattggtggggtatttggtattagaataatggttttatcattatgttagaaagaagggtcctcatctacattctcaaacatctgtggctgatatgatatgattcttggaatttgcttcaaaataataagtctggatgttaagtgcattggaaatattgatgaaacgaaattggccttgataattgttgaagctgggtgatggctaaaatgatggttcattatatatgttcatctctatttttgtatgtttggcattttccgtaataaagtttataaaaataa

SEQ ID NO: 2372 - DNA, 6598 bp, Homo sapiens
atacttttttcaatttttattatggaaaatttcaaacatatacaaaagtatagagaatagtataatgaactctcaaacatccatcacacagcttcagcaattaccaatttatggccaatcttgtttcatctatgtactcaattaccccacactcagatgattttgaagcgaataccagtaacatatcatttcacctgtacatttttcagtatacttctctaaaagataatcattttttaaaacaacataaccacagtaccatatcacatcttaaaaaacaataaatcaagaagttatatttttatttcaaattatgtaacaactggggacacaatcaatacatttcactggtatcatgaggaagagtgtcacactaaaatggagtccaagcttttatcgatgcaattgctttataatataaaagaaaaaatcaaacaaactagcatattagaaccacttttggtaatttgtaaggagctgaagactgctgatatcacacatcccatggcaaactccgtaagatttcttctaaacatctttgttattttcttaaaattgttctggaggcagctgatgcaagtcctcttttttaaaaaaaccttcactttgtgttcccctctaatagcagcctctttcctaaatgccttttctaaatgacaacaattttgccctctctcagccctctgcattctcatatgcagaaaccaggtaggatgaggagctagctgtgtgtactggaaaagggatgaaaactacagccaaatggatcagtgagagaggcaaaagaaatctagacaaactaaatggcataattaagtttggaaactgcctatgatatagcctgttggctctggcatcaaataatacagtatgttaaatctgtaaaatgaggaaacagtgtttcctcaaagagatgttaagatgacatgtaagaagtggttagggcaggcattgcaaaaaaatgtcttatatatcattttaaaatttatttttataaaaactcacaacattattttgcgtccactgtatttatttttacaattacctttatagcaagtgatagtttttgaataaaatttaagcaaatcatcaacagtacaaaaacactagagttgttacacgaaggactgattctacaaaacattaccctaggtgatggcataatcttaaaactgtgcagctactgtgtggtatgacatagaaataggagtaataattcttgtcctcaaacatcttacaactgtcttgaaatatttctgaaacacctgatacacaaaagccacacacatggtgcctagatagcatatactctactagcaccagattggaaggggaatgttttgccacacggtgattacaaaatattaattgaatcaaagaaccttcagtgatgccaaccatatttcaagtagtgtctcagatgcagaatatgcaaagagtaaggaaaaatagtctttgctctcaaagacatcatagtctaatgaaggcagacacatcaaaaaagcacaacaaaaggctataggtgctgaattaagagtctattcacgtataagagtacaacaaccagagcaagagtcagtggtatagacagggaaggagtgtcccaagatgcaggaagaaaccagatgagctgtcttcttgggaacacagaagtgctcacctgtacttgacaattccactgatcactgggttcacatcaatgtttctttcagcacaatactgaacatctttgctgttcatctggaaaaacaaaccaacacacaattagcaggcttatgttaataattcctccaactgacaaatgtaccaagagcttattatgtacatcaatcactttgcatcaagcacttcacttccacagaattatctaatgcagatgcaatcaatgagtctggatcagcaactgaggggttataagccaatgtataccatgatgtaaaaaagtcaggaaagcagcgatatcagaagttttgtaaaagaggagtgaccatttaagacataaaatatcctaaattccatgttacagactctagactcatggaaataattcaggctgattcccacccacgaaagagttttcagtccagtgaccacatggccaagaaaacagattaagtacaataaactctgcgaaccatgacacagaagagggtttcttaacccaggtggtcaggaaaggcttctcattggagatgtttgtaaagtgtctatttttactatctccaacaacagattttttttttaaactgagcgtcagatagttagataacttggcttaagtttcagtgaggaagaactggaactagatctgtctgacttcaaacccccaatgtagtttctatcacatcatgcgctcactctttttttttttttttgagacgtagtctcactctgtcgcccaggctggagtgatcttggctcactgcaacctctgcctcctggtttcacgagattgtcctgcttcaacctcccaaatagaaggtattacaggcacgtgccaccatgcctggctgatttttgtagttttacttcattaataattagaagtagagttggggtttcgccatattggccaggctggtctccaactcctgacctcaagtgatctgcccacctcgacctcccaaagtactgggattacaggtgtgagccaccatgcccagcccatgctctcttattcttataaaagtgttatgttttagcacagtcagcatagtaacttccacttcttatagtgctgtttgcccaaacatatttaaaatctgctaaataccattagtattaatagctatcttatcaagagaccactaccaggaaaatattgtttaaagtctttcagagagtacctggtggctcccccacaagggaattctagaggtgaaagctctgccaggcaaatacacattttctaactgtaaacaaattggcattcttatactaaccttctgaaatgaaatcacagaaagaatttaaaacctttacatcaattgttgcaaatgaatctatgcaaataaagcaacaaaattattttcgagtttcttccctttagtttgtttctttaaagtgtagtcaacagattttgtatctaaacacacacatacttcttgagaaaaactgtatatattatagacacagcaccaattgtttccagtatatgcatctatattaatgtttcctctttatatattcacaagaataaaacacttgaccagctgaaaatgtaagctatttataaaacatgcagaaaataaatctgattcatgtctgcaaacctcaattgtctgtgtactctttttcctttctttatcaagacagggctgtaaaatttaggtgtacatttttctgctatcacaaaagaaataatgtacaagtgaactctactactcttagaaggaaaaaaatctcaactatacatcaaattttggagcactgaagtggcagaaattttctatatactacctctgttctaaagaaatgtggtgccactgttccgaaaacaaatcttataacacatttaagtataggtaaacaaagtacaaatctcagtttttcaaaacattttctgtactaatgcttttaacttgaaactcttgacttagttttgaagagaaaaaaagaatctccttggcgctcttaactattctgatgagactaagttccagagaatattttacaaaaactacttaatttaacagtacgccttgaaaagtaacactacatattctaagtgtttctggaaaaaaaaaaagaaaaggaaaaaccacgacatatttataagctaacaattcttaagagagggttactatgaatgctgtacattaatttttactttgtcagatacataacttaagaaccaaataagatgatgcataattacttctaatgatagaaagtacgagttaagtctccaaagtaatcgtgacagtgtttcatgtggaacacatttcatctacaaaaatatccataaaatacaatctagtatacctcctaggtcaatattaatgtagaaacaagaaccttctgtaataattaggttattgaggaaaatcttaagatccattttagactgaataattaagtcaaattgtttggaatttaaaatatgtgcttcatgatgatgaaataatctgtacaacaaataaccatgacataagtttacctgcggaacaaatctgcacttgtacccctggaattaaaagttacaaaatattttttaaaatatgtggttcaaatatatatattcaacatgtatcactttgttaagagaaaaatagaaaaatactccgtatttgatcagaccatgtaattcagataataaaactgttgtaagttttaaaaagccacaatttctagtttactctttcctttgatagcattagtgcagaaaatattttgagaaacagatttgtactttgtttacctatacttaaatgtgttgttgtaatatttcttttcaaaacagtggcaccatatttctttagaaagtgcaacggcactcactgtttagcagcataaaaaatattatttgtgaaattacaatgtactccaaatagagaaaaatatttcagtgttttgaagggtaaaatacaaaaagcacacaagggggcagcaaaaaaaaaaaacagcagagacggtttcaaaaggaacttttctatggtattaaaagacaggagagcaaaataatgagtaggaggtttttggattacaggcaacgttaagttcttgatgtagatgctggtcacctgcacctagaatagggtgtcctgtgagacaaaacaattattctctatcgttaagagagattgttcaggaatcctaatagtttgacaattctgtaccagctgaacatcactagagctaactcagttgggatgtaatcaccataaaagattccattcctgtggttactgggagtcagggaggtttaagcggaatgtcactacattcaaatatgggagggagaccactttcaaaaacgaacttaaatccagagaaccatggttcttctatggtatccagtaaggggcaatgggagttggaagttgagtatgggaaatcaaattctgtgaatacggtttttctgataagatgtgtttggctagcagatcctccgcagcatctattcaataaggttaatctacatgggaaatagccatttgaagtcagcagtgaaaaattaccacttgtgaaaattttttgaaaaccaaatgatctacatatagaaacagaaaaagaaatttctgaaaggggcaaatgagatcccatttcagaagctaaagtgactgtagagtgcagaaagagcacaacatgtaggatttcccaatttttaaaaaaattcaaaactgatcttttaaaccaactcccaccacagaaggcctccctgacaacaagggcgaacgctgtgaaggagaaaactaaaggggaaaaagaatactaaaagatgccacacaaccaagctggtcagactttaaaggcctccactaccaaacaaaccacaaggctggtatcaaaaatgcgcacgcacgctcacccacgaatatgtgtgaaatataaaagaaccaaaaacatcacagggcgcacaggcagacacacactccacacacaatccccacccacccctcgccccccacacacacctcccaaaagcagggtgaacagttaaggcacctaaaaccccaagccgcataggcttccccgaaacattttacagtgtaaccaagaagcgattttgaaagcatctgaaaaacgtgcaaactgtcttgaaaacagggcctggcaactgagacagtttgcaagcgtgattcagagggtctgccaaggaaacaaaagaagcctccctcctccccgtgagaccgcacatggcacgagaggtgctccaggcgggacgcattttaagcgaggcagacaaatagaagtctgcgcgagcgcaagcggtacatactagggatcgctatctggcgaggatggggccatggagtttccattggttggggaaccgcccagctttagtttctccagatattcggcgtgcacgggcttgtggcactggagaaccttgatggcatcttcgactttgaaccactctcgcttcctcccaatgctaaccgaatcttcccaatcctccagcagctccgtgacagtcagtacatacacgtacgttctgtgcttgcgatcctggttctgttcgaagacgcccaggagccggcctaacttccccttgactcccgcttcttcgtacacctctcggaccgccgcaccgcccggctcctcctcgggctccatgcccccgcccggcacgatccagcggtccgggtaccggctgctactcactaacaggacctcgtcctcgcgttcgctccggaagcacaggcacgccgcccgcttcttgaacccctcggggtcgtaggtccgcgtctggttgggtttgcacttcatcctcgaggcagcctcctcgaggcagcctcctctcgcctctcgctgctgtgtgggccgccgctgccgctgccgccgccggggaacagccgaggtgctgggaagagaaagggccgaggcgaggggcggggaaagagaggcgcctccgtctgcccgcgagcccggg

SEQ ID NO: 2373 - DNA, 2847 bp, Homo sapiens
tggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattccgtatttggataacttgccaaacttcaacagatcaattgatggaccaataagactgccaattgtggataagtacaaagatatgggcactgtggtcctgggaaagctggaatccgggtccatttttaaaggccagcagctcgtgatgatgccaaacaagcacaatgtagaagttcttggaatactttctgatgatactgaaactgattttgtagccccaggtgaaaacctcaaaatcagactgaagggaattgaagaagaagagattcttccaggattcatactttgtgatcctagtaacctctgccattctggacgcacgtttgatgttcagatagtgattattgagcacaaatccatcatctgcccaggttataatgcggtgctgcacattcatacttgtattgaggaagttgagataacagcgttaatctccttggtagacaaaaaatcaggagaaaaaagtaagacacgaccccgcttcgtgaaacaagatcaagtatgcattgctcgtttaaggacagcaggaaccatctgcctcgagacgttcaaagattttcctcagatgggtcgttttactttaagagatgagggtaagaccattgcaattggaaaagttctgaaattggtcccagagaaggactaagcaattttcttgatgcctctgcaagatactgtgaggagaattgacagcaaaagttcaccacctactcttatttactgcccattgattgacttttcttcatattttgcaaagagaaatttcacagcaaaaattcatgttttgtcagctttctcatgttgagatctgttatgtcactgatgaatttaccctcaagtttccttcctctgtaccactctgcttccttggacaatatcagtaatagctttgtaagtgatgtggacgtaattgcctacagtaatgaaaaattaatgtactttaatttttcattttcttttaggatatttagaccacccttgttccacgcaaaccagagtgtgtcagtgtttgtgtgtgtgttaaaatgataactaacatgtgaataaaatactccatttgaaactcttcggttatttgaaatgcttttgaataatgtttaaatgtcattatgtaatgctattcaattagctttattactttctcaaatagttgaatatgttctatcacttaaaaacttaaaaactcttcaccacttactgttttaagtgaggaatttacaaacaatgcataagtgtgtattaaaggaataattttaattttgagaaaaaaacgtatgttaaggctcttcccagtgggctttgttttctctgtccaagtccagtcaataaaggagctcttctgcttccccacttgtgatttgaa

SEQ ID NO: 2374 - DNA, 1303 bp, Homo sapiens
tcaggaagctgcggggcctcagctgcgagggcgccgccaaggtcctgctggacaccttcgagtacccgggcctcgtgcatcacaccgggggctgccactgcggcgcggtccgctttgcggtctgggcccctgcagatctgcgcgtcgtggattgcagctgcaggctgtgcaggaagaagcagcaccgccacttcctcgtcccggcctcgcgcttcacgctgctccagggcgcagaaagcatcgtcacctatcggtccaacacgcacccggcgctgcacagcttctgcagcaggtgcggggtgcagagtttccacgcagctgtctctgacccccgcgtgtacggcgtcgccccgcactgcctggacgagggcaccgtgcgcagcgtggtcatcgaggaggtcggcggtggcgacccgggggaggaggccgccgaggagcacaaggccatccacaagacgtcctcccagtcagcccctgcctgtccccgcgaacaggagcagtgattggggccgcaagcccgcctgaaaccggcccgggcggccctgcggggagcgtccgagtacctgcacagatcccatgctgtgaaagaggtgtttctggcctggtcacaccggggattcccttccagtatttgcccttcccctccgctagttttcagtgaactcgcttacgatccaaatcttgaacacacctttgtctgcgtagtacaacgttaatcttgcaattcggtaaggaagaagagtgtctctgatttttcaaaccatccattgtatctctcgcttttactgttctgcctacagttgtcacaaatcacctgcagatgattcctgtgtactgtacgttcctggtgctattgtgaacaggcttgttgttttcagcgctttgcctctggtgtgtaggacggcaacacacaaccagtttgtaaacatgtgctaggacgtcttccattgattatggtgtgcgtgggctcccgcacctgtgagtttcaggtagacgttcatattttcactgcttagattcgagttatgctatttactggtttttaaatgatatatttcaagatttggtcgtgttacatacctcattactctttatttcctgtaacagcgaaagctgttactatttcgcttgttgtttgggaagtgtctctgggtaaggagatggggatacaggaatgagaaagacatctgtgcacacaggaatgagaaagacatctgcgcactgtctgccctctttaatcttttgaaatacctgtcttgtacatgtgttaagtatatagaaatcagtaaataccttctaggaa

SEQ ID NO: 2375 - DNA, 1304 bp, Homo sapiens
gtttcctagaaggtatttactgatttctatatacttaacacatgtacaagacaggtatttcaaaagattaaagagggcagacagtgcgcagatgtctttctcattcctgtgtgcacagatgtctttctcattcctgtatccccatctccttacccagagacacttcccaaacaacaagcgaaatagtaacagctttcgctgttacaggaaataaagagtaatgaggtatgtaacacgaccaaatcttgaaatatatcatttaaaaaccagtaaatagcataactcgaatctaagcagtgaaaatatgaacgtctacctgaaactcacaggtgcgggagcccacgcacaccataatcaatggaagacgtcctagcacatgtttacaaactggttgtgtgttgccgtcctacacaccagaggcaaagcgctgaaaacaacaagcctgttcacaatagcaccaggaacgtacagtacacaggaatcatctgcaggtgatttgtgacaactgtaggcagaacagtaaaagcgagagatacaatggatggtttgaaaaatcagagacactcttcttccttaccgaattgcaagattaacgttgtactacgcagacaaaggtgtgttcaagatttggatcgtaagcgagttcactgaaaactagcggaggggaagggcaaatactggaagggaatccccggtgtgaccaggccagaaacacctctttcacagcatgggatctgtgcaggtactcggacgctccccgcagggccgcccgggccggtttcaggcgggcttgcggccccaatcactgctcctgttcgcggggacaggcaggggctgactgggaggacgtcttgtggatggccttgtgctcctcggcggcctcctcccccgggtcgccaccgccgacctcctcgatgaccacgctgcgcacggtgccctcgtccaggcagtgcggggcgacgccgtacacgcgggggtcagagacagctgcgtggaaactctgcaccccgcacctgctgcagaagctgtgcagcgccgggtgcgtgttggaccgataggtgacgatgctttctgcgccctggagcagcgtgaagcgcgaggccgggacgaggaagtggcggtgctgcttcttcctgcacagcctgcagctgcaatccacgacgcgcagatctgcaggggcccagaccgcaaagcggaccgcgccgcagtggcagcccccggtgtgatgcacgaggcccgggtactcgaaggtgtccagcaggaccttggcggcgccctcgcagctgaggccccgcagcttcctg

SEQ ID NO: 2376 - DNA, 8754 bp, Homo sapiens
aggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgatccgcctgccgtcctgagctgctactgcacgcctcttggagcgtccccggctcctgttcgtgcccactttccgcataccgccccacccctcattttgcccttgccctacttcacccctgccacatgtttagtacccgcctggtcccccatcgcccctcgcgggccccctagatctctgcctcagcccccctgtttttgcacccaccgcccgcctgcagctccgctgctgcgctgccacccgggctccctattcccaccccacctcctgcctcagaggcccagagatttaattttttcccccctgtgtttgcaggctgaggcctccgtagaagacagcgccttgcttatgcagaccttgatggaggccatccagatctcagaggctccacctactaaccaggccaccgcagctgctagtccccagagttcacagcccccaactgccaatgagatggctgacattcaggtttcagcagctgccgctaggcctaagtcagcctttaaagtccagaatgccaccacaaaaggcccaaatggtgtctatgatttctctcaggctcataatgccaaggatgtgcccaacacgcagcccaaggcagcctttaagtcccaaaatgctaccccaaagggtccaaatgctgcctatgatttttcccaggcagcaaccactggtgagttagctgctaacaagtctgagatggccttcaaggcccagaatgccactactaaagtgggcccaaatgccacctacaatttctctcagtctctcaatgccaatgacctggccaacagcaggcctaagacccctttcaaggcttggaatgataccactaaggccccaacagctgatacccagacccagaatgtaaatcaggccaaaatggccacttcccaggctgacatagagaccgacccaggtatctctgaacctgacggtgcaactgcacagacatcagcagatggttcccaggctcagaatctggagtcccggacaataattcggggcaagaggacccgcaaggtgagatctctgctaacttcattttgctttggggctgtctcctttcttctctgagggtgttcatttgttctaaacaaaacaatgtatgtaactgtattcagctaggctatagggcatttgaagagaatgtttattcctgtcctccggatgttcacaaactgatggggagataatacatggacacaaataatatatacaacctgtatgtaattcagtttacattttgttatgttagtaaccaccatgtgttaagccttgagctaggcacattcacacaggttgtctcattaaaccttaaaggcacctcctaccaggtagggatcatagtgccaattttacaaagaaggaaattaagtgccagagaggtgaagtgacttgagtgatttgttcagggtggtacaggcagaaccagtggtggacataggaagaggagaagcctcaggccccatctttgggttgctcctggcctggctcggagatgaaactcctgcctggaagacagtgaaagacaaacccaggactcagggtgaccaatggctagtgggtcaggctgtcactacaggtgagggtttagagggcattcctggaatagataaggtgaggacacagaacccactggtgattctgaacttctctctgatgatgcagattaataacttgaatgttgaagagaacagcagtggggatcagaggcgggccccactggctgcagggacctggaggtctgcaccagttccagtgaccactcagaacccacctggcgcaccccccaatgtgctctggcagacgccattggcttggcagaacccctcaggctggcaaaaccagacagccaggcagaccccaccagcacgtcagagccctccagctaggcagaccccaccagcctggcagaacccagtcgcttggcagaacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttaccttcagggtgagacatcccctccttggagatctaaggaaacttctcacctatgagtttgtaaagcagaagtaagtgatgcctaaggggcttttcctgcttcttatgattctgcctgtgtgctggtcagctttagaaagcccttcctggctggatacaatggctcatgcctgtaatcccagtactttgggaggctcaggtgggcagatcgcttgagcccaggagttcaagaccagcctgggcaacataacgaaaccccatctctacaaaaaaatacaaaaattagccaggcgtggtgacatgcacctgtagtcccagctacttgggaggctgaggtaggggagaatcatctgagcccaggaagttgaggctgcagtgagctgtgatcatgccactgcactccaacctgggcaacagagtgagaccctgtctcaaaaaaaataaaagaaagcccttctcaagctcgtttcttacactatacttgtgcatatgtgtttctgtgcatacagaaacacttatgtcctcaggagtatttattgcatatactcctcatggttaaattctttattttttatttttttattttttgagacggagtttcgctcttgttgcccaggctggagtgcaatggcgtgatctcggctcaccgcaacctctgcctcctgggttcaagctattctcctgcctcagcctcttgagtagctgggattacaggcatgtgccaccacgcccacctaattttgtcttcttagtagagacggtgtttctccatgttaggctggtctcaaactcccgacttcaggtgatctgcctgccttggcctccagaagtgctgagattacaggcgtgagcgaccgtaccgggcgaattcttttgtttgtttttttcgagactgagtctcactctgttgcccatgctggagtgcagtggtgcaatcttggctcgcttgaacttccacctcccaggttcaagcaattcttgtgcctcagcctcccgagtaactggaacttcaggtgcgtgccaccgtgcccggctgtttttgtatttttagtagagatggggcttcaccacgttggccaggctggtctcaaactcctgacctgaagcaatccacccacctctgcctcccaaagtgctgggattacaggtgtgagccaccacacccggccagaatttttctaatttttctacttttctaagcagttgtcttgcaagtgaagcccatccaccatccccacagtagacattcccaaggctgggccaggctgacacttttgcactgcattgtactcatttcaatggacctctgtggctcactgacaagattacaagaatctggagctagagctcaggcagaaggagtgaaaggaaatgttgtcctttctgtgaccctatacaagcctcgcctgcatctctagtgagtgcttagcgttctagtgcaggaatttaaggcttgatgattaaggggtaaataccctgatggtgttcaggaatgagcccaagggggagttgctatctgaaatctgttaaaaaatgtaagattatttttcattagtggactaccattctgcctgggtaggtagacacaaagactgttttgctctttcagatacctggactacagacgagtgcccaacagcaaccccccggagtatgagttcctctggggcctccgttcctaccatgagactagcaagatgaaagtgctgagattcattgcagaggtaatggaggaactgttccagcattgataggtcaagggatgaagtatagctggctgggaaaggcccagggtaggaatgagatcctaggtgtggcaggtggtaggtgccgcattgctggtggtatttgttgttgctgttaggtaaacttaacatgtattaggtgctaacatatgttaatatattagctaatacaattatgagtttgttttgggtttttttttaggtttttaaagtatttttattttttcccaactttactaaattataattgacaaaaattgtatatatttgtggtgtacaatgtaatttttaagtattttgttttatttatttatttatttgttttctcccgagatggagttttgctgtgttgcccaggctagagtgcagtggcgcaatcttggctcactgcaacctctgcctcccaggttaaagcgattcttgtgcctcagcctcccaagtatctgggattacaggcacgtgccaccaccatgcctggctaaatttttatttttctattagagacagggttttgccatgttagccaggctggtctcaaactcctgacctcaagtgatctgcctgcctcagcctcccaaagtgttgggattacaggcgtgagccaccgtacccggcccattcatttatttttaactgactaataaaaaatatacatatttatggggtacagtatgatgttttgataatacatgtacattgcagaatgattacatcaagctagttaactctccatagcctcatatacttgacattttttttgtgatgagaacatttaaaatgtactcttttagcaattttaaataaacgacacattattattaactatagtcgtcatgctatacggttgatctccagaacatattcttcctatctaaatgaaactttgtaccttttaaccgatatctccctatccctcctgaccccaggccctggaaactaccattctactctctgcttctatgagttagacgtttttagattccatgtataagtgaggtcatgcagtatttgtctttctgtgtctggcttatttcacttagcataatgtcatccagcatcatctatgttgttgcaaatggcagaatttccttctttttaaaggctgaatagtattccattgtgtgtgtgtgtatcacattgtccttatccattcatccactgatggacaggtaggttgattccatatcttggctattgtaaatggattttgttttgttttctattcctcatctcaggttcagaaaagagaccctcgtgactggactgcacagttcatggaggctgcagatgaggccttggatgctctggatgctgctgcagctgaggccgaagcccgggctgaagcaagaacccgcatgggaattggagatgaggctgtgtctgggccctggagctgggatgacattgagtttgagctgctgacctgggatgaggaaggagattttggagatccctggtccagaattccatttaccttctgggccagataccaccagaatgcccgctccagattccctcagacctttgccggtcccattattggtcctggtggtacagccagtgccaacttcgctgccaactttggtgccattggtttcttctgggttgagtgagatgttgggtaggtacatcactttggattgggcagttagggtctctgggggatatagggtccatggggttgtatttatgtgcatgagctagaagtattaggaaactcattgtagggagatgaggaaagtatggggcagcactctttggtatgtatattccttattatttgatatatatcattgatttttttacttcttctttcttatgttcacagatattgctatcaatcgcagtagtctttcccctgtgtgaggctgaagcctcagattccttctaaacacagctatctagagagccacatcctgttgactgaaagtggcatgcaagataaatttatttgctgttccttgtctactgctttttttccccttgtgtgctgtcaagttttggtatcagaaataaacattgaaattgcaaagtgaa

SEQ ID NO: 2377 - DNA, 8754 bp, Homo sapiens; identical to SEQ ID NO: 2376

SEQ ID NO: 2378 - DNA, 128 bp, Homo sapiens
cacatgtagggcatttgtctgtagggaggccacaagtttgtgcccctcatcacgatgaccccagcttcctgttgggtgtgttgtaaacagaggagccattcttcaggccccctgctctgagcacaccc

SEQ ID NO: 2379 - DNA, 128 bp, Homo sapiens; identical to SEQ ID NO: 2378

SEQ ID NO: 2380 - DNA, 7447 bp, Homo sapiens
cgcatgcgcaggctacccagccgcggggggtgcacggagaaaaggggcggggtggtccgggctgctgtgctggcagcagtaggcgagggcgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 2381 - DNA, 7447 bp, Homo sapiens; identical to SEQ ID NO: 2380

SEQ ID NO: 2382 - DNA, 7447 bp, Homo sapiens; identical to SEQ ID NO: 2380

SEQ ID NO: 2383 - DNA, 7447 bp, Homo sapiens; identical to SEQ ID NO: 2380

SEQ ID NO: 2384 - DNA, 7358 bp, Homo sapiens
cgcggctgcggggttcctggtgctgaggacggacgccattggagttcccgagaaggtaaggatccagccccagacaggaccgggagagggcgagtggaacccgacacgctgcgccctccctccgcctccggatctgaacaaagcccaagcactcagaaccggaaccccattagacccaaggtctagataggagcccccatcaccatcagacccaggcgccccgatctgagccctactgaaaccggagcccaggatcctcacccctttagcagacccgtgtgctccgagctgagctcccttggacctgaggccccacccccaccccaaccactcctagattactcgaaccgagctgaccgcttgcccccttcctggagtgcccagtcctcgcgtttgagatctgcagcgctccgattggagcctcacctaggtctgaggcccccactccatccgcctctagtgctcgagtctgagccccacctaggccccccgcccggacctagccaaaggtccctggggttctgtttcgcagagcttgcggcttgccactgtccctgttgtctgagctctcccatctgctcccccttcatcccggtccccttctctggcccgtaaatccaaaccctttgtttctctcttccccaatgcattccctttgggactcttcggaccccagccctccagaacaccccctcgtcaaatctagccgctgggatggcgagcctgcccatcctaaactccgctttcagtgcggcgcctcctgcgacctcctctgtccctttccttgggctctgtccctgaccaggtctaccccatcagaaagccaaaccgtctcccccccgctcctcctccccccccccgccccctactgcctaatattgcctagtaacctgatgattgtcgcccctcacctcccgggagatcccgcctcccattggatcccgccccctccccctgcagctgcttcaccctccctctcaggctgagctctcatctccctgggacccgcagcatggctgagggaagcttcagcgtgcaatcggaaagctacagtgttgaagacatggatgagggtagcgacgaagtcggggaggaagagatggttgaaggcaacgactatgaagaattcggtgcgtttggtggctatggcaccctcaccagctttgacatccatatcctcagagccttcggaagcttgggtccaggccttcgcatcttatcggtgaggccccttcctggacacctgctggcctgggcctttcccctgtgaatgggggagggaggaggggggagccaggagggttgtgtgggaaaggactgcccagcttcccaagccttccctcccctgctcggaagaagaagatttgggaaggtcttggggtgttcagggctgactgctgggaagaggctggccagcacagggaagctaacacaagtatgtcgtcgagtggcctgccttccccaacccctctctctggccttgcagaatgagccctgggaactggaaaaccctgtgctggcccagaccctggtggaggcattgcagctggatccggaaacacttgccaatgagacggccgcccgtgctgccaacgtagcccgcgccgccgcctccaaccgtgcggctcgggccgctgccgccgctgcccgtaccgccttcagtcaggtggtcgctagccaccgggtggccacgccgcaggtctcaggagaggatacccagcccacgacctacgccgccgaggctcaggggcccacccctgagccaccccttgcttctccgcagacctcccagatgttagtcaccagtaagatggctgcccccgaggctccggcaacctccgcacagtcccagacaggctccccggcccaggaggctgctactgagggccctagtagcgcctgtgctttctctcaggctccgtgtgccagggaggtggacgccaaccggcccagcacagccttcctgggccagaatgatgtcttcgatttcactcagccggcaggtgtcagtggcatggccttcccgcgccccaagagacctgccccagcccaagaggctgccacagagggccccagtgctgcctctggtgtgccccagacgggacctggcagggaggtggcagccacccggcccaagaccaccaagtcggggaaggcgctggccaagactcggtgggtggagcctcagaatgttgtggcagcagctgctgccaaggccaagatggccacgagcatccctgagccggagggtgcagctgctgccactgctcagcacagtgctgagccctgggccaggatgggaggcaagaggaccaagaaggtgagatccccctgccccctgccacctccacacccccttgctcctgtcctttccttctcctccctttcctgctcctctcctccctctcctctcccccttcttcctctcttctcctctttcccctccttctctcctcacctcccctctcctcccctcctctcctctcagctagtccatgtttctccaacacaagtttgctgagcatgttttcactccacgtagtccctaccctcaggactggtgggagaagaggctggctcagtgcctggcacttagtaagcacgcagcacatgccagccgctgctggtactgctctcatttccaagagcctgctacgggtgaggtgcgtgccgggtgctttggcacggggagcctggtagccctgggtctctcctctctcaaatgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggtaagaagcccaccctcccccatctccttcctctcctcccttgtgggccacgtctctgctgtcacccatgccttgacctccccgcatgttcctccttctccaggcaaataagttggtgaaatacctgatgattaaggactacaagaagatccccatcaagcgcgcaggtaggcagcctgtgcccccttcaccatcccctagtctgtgggcatccctttgcttgcgtgccacggctggtccctccatagccacaggacggggtcctggctgcgtcaccctcggcagagctgaccaaggggctacagctctatgacccctgctcagcccaggtgctttctccaactcttccccctcctgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctctctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaagtaagaaagggaaagcgggtcgtggccttcctcggtggtgtcccttccctgcccacaccccttcagtgaagcaggaagacggggcttgagtgcggcgcaccgctcccacacacagcgagggctgcctggtgactgctggatgaaaggaatgatagcctggggtgaggccttgctgccatcagttctccccaagctgctgccgggctttatccccaaagcttcggaggaaagtgcctcttcctcctgcctgcctggcctgggcctggcagagctggcctaggggagagctgcctcttcagtgtaggtgctgatgtggaaggggcaggaaaggtctggagccatctctgggcacacgtttgccatttgcagagcttcggctccctgcctcgccctgtcctctgcagaaccctgtcagggaagtgttagtacccatgttttatagaggaggcgattaagtctcaggcggaggtgcgaatggtctgtcagcagctagtgaactgtgcctgtcctgggaagagttcccctcaagctgggaaacctgagagaggctagttgggagagcctggtggtgtctctcaggcaaatagctgctaaacaggatttctctttccacacctttagaaccaaggacactcccaggctgagtctcctcttggtgattctgggcgtcatcttcatgaatggcaaccgtgccagcgagggtgagtggctggacctgcaactggggggctgcccatagtctcatcttctgggtgccaaactctcgtacctcctctcccctcgcagctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgtccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccaggtaagggagcgcctctgttgggtgcccggcaccgggggtggtgctctccacaccttgcttgtttcttggtcgaggcctccttcccattaccccgtattccagtgagggtaccaaacactcacagaggcacctgagcaccctacacaaggtcacagatggggcaaaatcccaggtctggcacaggagagtaggagcccccaatccctgtggtcctgatttttgccatcattgcacaaagcacacgggagggggtgaggcgggccgcgggtgctcagccagtgtggggtagctctgtgtctatgcctgcccttttcctcctcagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccacgtggagagctggcgtcagcagtggcaccaatggaggggccagcaccagcgtcctagatggccccagcaccagctccaccatccggaccagaaatgctgccagagctggcgccagcttcttctcctggatccagtaagagtttcggtagagaaatgagactctgcaggagggctgcggaggggggtgagatgtcagagggagggccggggtgggggcgctgggggcaacggcaacagcatggacggacacttattttgttacgtacacccctccctggttcgcgtgtgtccacggatgttgtcactttggtttcttgtgcttttataggcaccgttgacgaactgcagcgatcttactggccaagccagagcgcctcctctcagattccttctcgacacagcaccctaggcggcttcttcctgtcagtcggaggtggcatgcaagatgaagctctctttgctcttcctgctttcattttgtgcttttccttgtgttttcatgttttgggtatcagtgttacattaaagttgcaaaattaa

SEQ ID NO: 2385 - DNA, 6746 bp, Homo sapiens
aaccagggaggggagggaggactgcatgacgcgggatggggtggggcgaggcggggcactgcagcacacaacgcaggcaccgacttcagtgtgcatgttccttggacacctgcctcagtgtgcatgttcactgggcatcttcccttcgacccctttgcccacgtggtgaccgctggggagctgtgagagtgtgaggggcacgttccagccgtctggactctttctctcctactgagacgcagcctataggtccgcaggccagtcctcccaggaactgaaatgtgagtgaatgtgaggaggagtgagcgggcttccagagggtcaggcggcgtggtctgtggcctcagagagtaaaaagcttccaggtcataaggaaggtgggccgcggagtgaaggggagccagatgaagatagggtgaatgctcggggtgctgttggaggtatctgagtcccgaaagtgcctggaactcccaatgggacagattccagacttcttggtagggacccaggaatgggctgtgtaagcggtaagaaaggggcctgggaagtgggaatgctatgagctggtgaccgcgaccccgaggtctgtagagctccgggtagaaatgtccagcgaggagcgtccagtgatgtgtcacaacttctcaactccaccctggaggttcgaatgggcgggactgtgctttccaacaaaaccttgattttagggagggaaatcgtccaaacaaatgggtgtgtgacgaaagccgtggtcactgcagttttaattctctagctgtataaacttaaatgtctccactatggagaatccaactgtgaaaccaaatctcatcagaaatatcctgtatcttttgccaggagcattaagacattgctctgctagattgcccaacttaagtggctatgcaagcattcgattcagaagatgtacacacttctagttgccctgggacttactttcaaattatttccaaacttttttaaaaactgaaatttaacatttggccatgaaagtggtcaaatacagctatcctctcaaacacactttcccaatcacagtattctgtttgcagagtgaaatatgagttggcgaggaagatcaacatataggcctaggccaagaagaagtttacagcctcctgagctgattggggctatgcttgtgagtgctttaatattttgatgttttttattagcagaaatttcttttgtgatagtgttgttgaactagtatagatacactgataaaggtcttccatgttgataaaaatgatcatgcatctcatgaaggaaagactaatccaagagtattacaatctgattttgccttcatggataatcttgtgttccccatcatgacttcctcctcatgcttactgataacagattgcacacatccaacccaacatagattaaaatggtttccaaagcctttgagggtaactgtcttagagtaacctctctttgggaagagtaactttgtgaagaataagtatgtggaacagtgttggagaagtgtctttagacttacttgtgattagaaatacctgtgtattctgtatatttgtattattgacatgtattactaacaaaactttttatctgcacacatactgcctcccctttgtcccaggaacccactgatgaagagcctaaagaagagaaaccacccactaaaagtcggaatcctacacctgatcagaagagagaagatgatcagggtgcagctgagattcaaggtgctgggaaaggaaagaaataatgcctatagggggaaggaggcctatgtgtccatcatgccttatgccatgaccagtaataggaggaaagaaaacattaggaaaggatctcaagcacttgctcaaagtaggctggaaaagtgaagagtatagtttgcagcttcatgcagtccctggatataataaatcttctctttttttcaagatttattttgtatgcttgaaaatacatcccttgctaaatcagatgaaactgtttaatttgatgtatcaaaatgtacattatttcacttgattaatttgatcttcttagaatgttgctgtatgattggctcagccatggtgtccacagtgttataagcacccttttatagcatatagagtgccaagtcaccctaccttataacaccctgaataaagcccatttgcatagggatattagccctattttataaaaaggaaatggttgctcagagatagaggcttaccaagaacgcttgagtcatggaggcagaattcatattacgttccaaggtctgtgttcttcctaacatctacgttattagaaaacgtgaattattttgcttaaaacgcttaatactcgaatgtgtctgtactgtaaggtacttgagtattggctcaggagaaaacaaattcagtgaagcaggatagcaaatccggaaaagggctcaatgaatgacagccactgttccctttgatcagtattttttgacagtatgtttggtaaaaggtggatagttcaggacactggcatacaggtaggtatattagtatgctttttaaggaacttttaaaagttgcctaaatacttttataattagaaaactcaaagtatgatacaattatcatgaaacagaaattgtgtcctcaacagatagcattttcaagctaaagttgacggaatttggaccatggattattttagcagttcacggttaagaggtttccagaatatgactgtcaacaacactcattactttctttcactcaatttcctgaattctcatgggaaaactgtgactttttttcctcttatttttggtactatattctcaataggatttatttatgaaaagttacatttagggcctttggacctaagcataattttaattaattttaaccaaataattttcaaattacctcagcaagatatggttgtcacaattgtaagtttttgtcataagcccaggaatacattgatctagtctttcagaaaattatctttgagttattattaaaatgctattcatgcagcaaacttcagatatcttacatagttgatactcactgtttataatgcacactggcaaagtataggaaatgaaggtgtagtgtgatttatccttagattgtcattttatattagatttcaggccaggtacattggctcacacctgtaatcccagcactttggaaggccgaggctggtgggtcccttgagcctgagagttaggaactagcctgggaaacatggggaaacaccagaaaattttctctgccaaaaaaatacaaaaattagccttggtggtggcatgtgcctatagtctcagcctctcacaaggctgagacagggggataacttgagctcaggaggtcagggctgcagtcacctgtgactgcacccctgtactccagcctggatgacagagtgaaaccctgtattaaaaaacaaataaaataggaattcataatacaggaaaacaaaagtgtgacagctttgcatcacatttattatcacactagcctacaggcttttatgtcataactctgtggaatagaatattattacttccttatttatacttcatgtttttgtactcaagttcaataacctttgtattttttagtgcctgacctggaagccgatctccaggagctatgtcagacaaagactggggatggatgtgaaggtggtactgatgtcaaggggaagattctaccaaaagcagagcactttaaaatgccagaagcaggtgtgttattcattaagacacaaagttatgtgatttctattttttacaatattatacttttgatcatagagagataatattactgccactttaataacagtgttcaaatacacactttctttgaaaggtacttcagatcccaatgcctgactgcaagacttaaatgctctcagatacagacacaaattgggtcaaagccatattgaatcatcaaatatgacagcattttcttacttctgagtataaccaacagctaacaattttcagattcttttctaatttctgcttttaacaaatacataatgcatttgtaataccagactgtgtgaaatatgctgagtactgaaggagattctagtagcagctctatgacaatttgtgagaatctggacaaattccataaattctacacccatctttgctgttattgaaaatggtgaatgcagatcaaatgtattaaaatccgtttcaatgctgatttctgcatgctctggttctgttggagagaatagaaagatattctgattcccatgatttgtttttcctaacaatcagcttcagtccaattacaatatctgagctgagatttcattgctcctaagaaaatgagcaggcactctgcttgatgtttgttttccagcatggagacttgaatgagtgttcttggattttgtcaaattctgaattatctggcttttaaagaataattgtattttaaagccttcccaccgtgaagccttgaatgactgaataataaaatggcaagagacagtctactttctgtggccaatgaagtagggagaatgcatgtaggtcagtcatgctcaaggtgggtgtaagatgcctgtgctaagcatgctttttgctctcctgtcagtcttcatgagctactgtgtgtaataaagacacacatgatataatcacctctaaccatatcataggttacatattacaggtttctgccttgagacatcagatgataggacttaaagttcaaagactataatgtactaattcttgagtagtcaacataagtatcttttacacatttttttttataaattgctgactgttaatgagaagagcttctgaatttaaaggaagaactccatgtttagggaagaaattacctaaatgttttactctgcactgctgaaccattccattaaactatttacattaaaagatagttttcaggagccgattgaacaagcctcagttgtattcttaggaagatcacagccttaaatgcacatcttattagaatagatagcaaattacatgataaagtaataatcaatataataataaaagagcaacagaataaacctaatggaaaaggaaagaggtacttaataacagacaggtaggaacctggattttggattaggaaaactaatccaaaagtaatacatttaacacattgtttattttaaaaatagctatgaatagactatctatttgtttctccagtcttgaagaaaatgggaaaagcacaatacagaatatgaagaagacacagatattgaatatgtagtataactgaaagtaaatacattcttttgttttcttttgttttacttttgagacagagtctcgctctgtcacccaggctggagtgcagcagcatgatcttggctgactgcaacctccacttcccaggttcaagtgattctcctgcctcagctgagtagctaggagtacaggcatgcaccaccatgcctggctattttttgtatttttagtagagacgaggtttcgccatgttggacaagctgttctcgaactcctgacctcgggtgatccacttgccttggcctcccaaagtgctgggattacagatgtgagccaccacgcccagctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccaggagcctatttgacatccagaccatagtttcaagccaaaatattaaattgtacattttttataaattcctttgtttcttagtttttttgtgtgtatttgttatatttttagtaaaattatacacaatttttgctttatacattaaatccctttttaagagtttcacttgatttaatgtgttctgacctcggactgtcttttggtttccttgtagcactagaaagcagggtgtgtttaaaaaatattaataatgtatatgtttggaagtttatctccaaagtctccacagaggtctaattgaatgtaagccagagggtgactcttgggtttatggtcttagtccactgtacgaaacaaaaactttggtgtcatttgcatatcttaatgtgatctaaatacagttctgctagtaatgttccacctgttatgtttctattacaggtgaagggaaatcacaggtttaaaggaagataagctgaaacaacacaaactgtttttatattagatattttactttaaaatatcttaataaagttttaagcttttctccaa

SEQ ID NO: 2386 - DNA, 5578 bp, Homo sapiens
tatgagttggcgaggaagatcaacatataggcctaggccaagaagaagtttacagcctcctgagctgattggggctatgcttgtgagtgctttaatattttgatgttttttattagcagaaatttcttttgtgatagtgttgttgaactagtatagatacactgataaaggtcttccatgttgataaaaatgatcatgcatctcatgaaggaaagactaatccaagagtattacaatctgattttgccttcatggataatcttgtgttccccatcatgacttcctcctcatgcttactgataacagattgcacacatccaacccaacatagattaaaatggtttccaaagcctttgagggtaactgtcttagagtaacctctctttgggaagagtaactttgtgaagaataagtatgtggaacagtgttggagaagtgtctttagacttacttgtgattagaaatacctgtgtattctgtatatttgtattattgacatgtattactaacaaaactttttatctgcacacatactgcctcccctttgtcccaggaacccactgatgaagagcctaaagaagagaaaccacccactaaaagtcggaatcctacacctgatcagaagagagaagatgatcagggtgcagctgagattcaaggtgctgggaaaggaaagaaataatgcctatagggggaaggaggcctatgtgtccatcatgccttatgccatgaccagtaataggaggaaagaaaacattaggaaaggatctcaagcacttgctcaaagtaggctggaaaagtgaagagtatagtttgcagcttcatgcagtccctggatataataaatcttctctttttttcaagatttattttgtatgcttgaaaatacatcccttgctaaatcagatgaaactgtttaatttgatgtatcaaaatgtacattatttcacttgattaatttgatcttcttagaatgttgctgtatgattggctcagccatggtgtccacagtgttataagcacccttttatagcatatagagtgccaagtcaccctaccttataacaccctgaataaagcccatttgcatagggatattagccctattttataaaaaggaaatggttgctcagagatagaggcttaccaagaacgcttgagtcatggaggcagaattcatattacgttccaaggtctgtgttcttcctaacatctacgttattagaaaacgtgaattattttgcttaaaacgcttaatactcgaatgtgtctgtactgtaaggtacttgagtattggctcaggagaaaacaaattcagtgaagcaggatagcaaatccggaaaagggctcaatgaatgacagccactgttccctttgatcagtattttttgacagtatgtttggtaaaaggtggatagttcaggacactggcatacaggtaggtatattagtatgctttttaaggaacttttaaaagttgcctaaatacttttataattagaaaactcaaagtatgatacaattatcatgaaacagaaattgtgtcctcaacagatagcattttcaagctaaagttgacggaatttggaccatggattattttagcagttcacggttaagaggtttccagaatatgactgtcaacaacactcattactttctttcactcaatttcctgaattctcatgggaaaactgtgactttttttcctcttatttttggtactatattctcaataggatttatttatgaaaagttacatttagggcctttggacctaagcataattttaattaattttaaccaaataattttcaaattacctcagcaagatatggttgtcacaattgtaagtttttgtcataagcccaggaatacattgatctagtctttcagaaaattatctttgagttattattaaaatgctattcatgcagcaaacttcagatatcttacatagttgatactcactgtttataatgcacactggcaaagtataggaaatgaaggtgtagtgtgatttatccttagattgtcattttatattagatttcaggccaggtacattggctcacacctgtaatcccagcactttggaaggccgaggctggtgggtcccttgagcctgagagttaggaactagcctgggaaacatggggaaacaccagaaaattttctctgccaaaaaaatacaaaaattagccttggtggtggcatgtgcctatagtctcagcctctcacaaggctgagacagggggataacttgagctcaggaggtcagggctgcagtcacctgtgactgcacccctgtactccagcctggatgacagagtgaaaccctgtattaaaaaacaaataaaataggaattcataatacaggaaaacaaaagtgtgacagctttgcatcacatttattatcacactagcctacaggcttttatgtcataactctgtggaatagaatattattacttccttatttatacttcatgtttttgtactcaagttcaataacctttgtattttttagtgcctgacctggaagccgatctccaggagctatgtcagacaaagactggggatggatgtgaaggtggtactgatgtcaaggggaagattctaccaaaagcagagcactttaaaatgccagaagcaggtgtgttattcattaagacacaaagttatgtgatttctattttttacaatattatacttttgatcatagagagataatattactgccactttaataacagtgttcaaatacacactttctttgaaaggtacttcagatcccaatgcctgactgcaagacttaaatgctctcagatacagacacaaattgggtcaaagccatattgaatcatcaaatatgacagcattttcttacttctgagtataaccaacagctaacaattttcagattcttttctaatttctgcttttaacaaatacataatgcatttgtaataccagactgtgtgaaatatgctgagtactgaaggagattctagtagcagctctatgacaatttgtgagaatctggacaaattccataaattctacacccatctttgctgttattgaaaatggtgaatgcagatcaaatgtattaaaatccgtttcaatgctgatttctgcatgctctggttctgttggagagaatagaaagatattctgattcccatgatttgtttttcctaacaatcagcttcagtccaattacaatatctgagctgagatttcattgctcctaagaaaatgagcaggcactctgcttgatgtttgttttccagcatggagacttgaatgagtgttcttggattttgtcaaattctgaattatctggcttttaaagaataattgtattttaaagccttcccaccgtgaagccttgaatgactgaataataaaatggcaagagacagtctactttctgtggccaatgaagtagggagaatgcatgtaggtcagtcatgctcaaggtgggtgtaagatgcctgtgctaagcatgctttttgctctcctgtcagtcttcatgagctactgtgtgtaataaagacacacatgatataatcacctctaaccatatcataggttacatattacaggtttctgccttgagacatcagatgataggacttaaagttcaaagactataatgtactaattcttgagtagtcaacataagtatcttttacacatttttttttataaattgctgactgttaatgagaagagcttctgaatttaaaggaagaactccatgtttagggaagaaattacctaaatgttttactctgcactgctgaaccattccattaaactatttacattaaaagatagttttcaggagccgattgaacaagcctcagttgtattcttaggaagatcacagccttaaatgcacatcttattagaatagatagcaaattacatgataaagtaataatcaatataataataaaagagcaacagaataaacctaatggaaaaggaaagaggtacttaataacagacaggtaggaacctggattttggattaggaaaactaatccaaaagtaatacatttaacacattgtttattttaaaaatagctatgaatagactatctatttgtttctccagtcttgaagaaaatgggaaaagcacaatacagaatatgaagaagacacagatattgaatatgtagtataactgaaagtaaatacattcttttgttttcttttgttttacttttgagacagagtctcgctctgtcacccaggctggagtgcagcagcatgatcttggctgactgcaacctccacttcccaggttcaagtgattctcctgcctcagctgagtagctaggagtacaggcatgcaccaccatgcctggctattttttgtatttttagtagagacgaggtttcgccatgttggacaagctgttctcgaactcctgacctcgggtgatccacttgccttggcctcccaaagtgctgggattacagatgtgagccaccacgcccagctgaaagtgaatacgttcttaaactctaatattttcggaatatagatgaaatggttgataagctaggaatgcatgcattattaaatatatcccagtagtacctgaatatctattcatcacaaagactgtgcatgaacttgtgaaatttgctagttgtcccttgataatatttacttttagaaataaatatttagttattctagatgtcttcctctacatctccatttccctttccgtttcttttttttcgtgccatactgttcatgatatatacctctttcatattttgatatcaataatgataatgatagattaaaagtaatgcgatcatataattaattatacaaaggggaattttttcaagtgtaaaaagagatatttgtattaacatcaggactataggtgaaaactggggacagatgtttaccataccttaatatctacagaagggtaaactaacccaaagcaacatttttgcactttggcacaatagaggaaaaaacaaatgcaatactgtcctttctattcaccacgcatatgcagcttctaatgtgacattaactcttttcttaaaagatagttttcatactatttccaggagcctatttgacatccagaccatagtttcaagccaaaatattaaattgtacattttttataaattcctttgtttcttagtttttttgtgtgtatttgttatatttttagtaaaattatacacaatttttgctttatacattaaatccctttttaagagtttcacttgatttaatgtgttctgacctcggactgtcttttggtttccttgtagcactagaaagcagggtgtgtttaaaaaatattaataatgtatatgtttggaagtttatctccaaagtctccacagaggtctaattgaatgtaagccagagggtgactcttgggtttatggtcttagtccactgtacgaaacaaaaactttggtgtcatttgcatatcttaatgtgatctaaatacagttctgctagtaatgttccacctgttatgtttctattacaggtgaagggaaatcacaggtttaa

SEQ ID NO: 2387 - DNA, 11015 bp, Homo sapiens
gaaaatcagagtctctgcctccattttgagaaggttctgtccctggagcctggactgatagaccccacatcagcttggcttttcccacctactgttctgacttctgattggccagatggagttcactaactgccctgattggtccatcatcctggagcagtgacattgcaggatattttctcctcctccagccacactttgtcaccaactgctgccaactcgccaccactgctgccgacctcgccaccactgctttgtctctgaagtaggttctctttaagggacaccctagatgggctaatcggggcagatagaaaaggaggaagcttctgtagggccgtcaagtgcttggggttccgaaaatcttgaggactgaaagacaactaatgcctttcaggacgatcatcatggaggattctcccgccttggccttgggtgtacaggcctgtatcatcccacccctggtatttttgggggggggtattttagtagagacagggattcgttatgttggccaggctggcctcaaccgcctgggctcaagcaatcctcccgccttggcctcgggactgcaggcacgcaccaccccaccctcactagtatttttttatttatttatttattttagtacagatggtttcgctatgttggccaggctgacctcgaccgcctgggcttaagcaatccttccgcctcggccccaggactacagaagtgcaccatcctgcccacgcttttcttttttttttttttttagtagaaaccgtgtttcactatgttggccaggctggcctcaacctcctgggctcaagcgatcctcgtaccttggcctcaggactacagatgtgtgccattctgcccctgctagttttgttgttgttctttttactagagacagggtttcgctatgttggccggactgggcttgacctcctcagctcaagtgatcctcccacctcagcctcggaactacaggcaagaaccacctcgctgatgttatttttttgttgttattactagtagtagaaatggggttttgctatgttggccaggctggcctcgaccttctgggctcaagagatcctcttgcctcggcctccggactacaggcgagcaccaccccgcccccactaatactttttattttattttattttattttttttagtagagggtttcgctaggttggctaggctggtaccgacctcgtgggctcaagcaatccgccccccttgaccaaagtgctgagatgctacaggcctgtgccactgcccccagctaaattttgtgatttttttttttttttgtagaaatgaggggtttgctatgtttcccaggctggtctcatcctcctgggctcaagagatctgcatgcctcggcctcccaaaatgctgggattacaggcatgagccactgtgcctagctgattgctgcaaattgaaacaccccacattttctgtaagtgatggcaggctcatctagtctcagagattctagctctcttccttctaataatttacaaatcaccgagtaatagcctctaaatctgttcatattagtgaaggtcatttctcttcaacagaacagaacccctcaaccctctgcctgatcagatccatcaccagagagaccaggttatgtctgggactcacttccctccctttatttattgagtgggggtgtcagaacgcccccactgaatagttacacagtcacgtccctgcctccccaacaagggtctgtacatctttcagggtaagcctagccccagggaaactactaacaacactagccaaccccctcccaaagactcaaggctgctaggaaacctgtcatccccaagcaatacttctcccagagactccaggctccctgttttcgtctgacttctccccatgtccttactcagggacagataagccccgaatgcagacatgcaacccctaattccaggtgactgagtgtggccgggcttcactgatttctccctccataggaccaagggtcctgtagctagaaagtctcaggctgtttctctcgcaggtgagagtgctcctggtgccatgaacggagacgacgcctttgcaaagagacccagggatgatgataaagcatcagagaagagaagcaaggtgaggtgacctggagggggcagagcagtggtccaggggacagagtagggtgaccaggtttctgaggaggggaggacagaggtactggggacaaggagcagggtctccggggagatctggacccttgggagcctcccaccctcgctctgtcatcacctagcatccctggagacaagtctgtgaccttgcactatatttggtaactctcagtgcattctggaaggtgggaagagagccagacagcagcattaaagccctaatgtgtgccacgggagaagctagggtaggtcccccatggtctctcagttagccatggcatcaaccaggacggattatcatcctcacttcccagatccagcacacaggaagcggctccagctgaatggcagacatacctagctgagtcgccgccaaaatttctttttttttttttaggccttcaatgatattgccacatacttctctaagaaagagtgggaaaagatgaaatactcggagaaaatcagctatgtgtatatgaagagaaactatgaggccatgactaaactaggtaacagaaagttctaggaacagacaagtctggggatacatgagcatcccttttcctgctttggctacttcttaggctgcagaaagtaccccacattttccttttgtgcagggaaaaatcacaaggcagcttctgggtgttctgctcttctgtatcctgtcagagctgagggcagggactggccatagtggagcttgtacctggaccctgcacttttctctcccttaggcatctgttctgatgagcccaacggtctctgtggcattgcagcacacctcccaccctaccttccttctctcggcttgtctttttctctctctctcccttttttttttttttttttttttttgagtcagagtctcactctgtcacctaggctagagtgtagtagtgcaatcatagctcaatgcagcctcgaactcctgggctcaagcaatccttctgcccagccaatggaatagctgaggctacaggcacatgccaccatgcccaactaattttattttatattttgtagatatgggggtctctctatgttacacagtctcatcttgaactcctggcctcaaacaatcctcctgcctcagcctcccaaagtgctggtacgacagacatgagccaccgtgccaggcctaagtttgtcccttaaggaataaacattttgcttctttctaggtttcaatgtcaccctcccacctttcatgtgtaataaacaggccacagacttccaggggaattattttgataatgaccgtaaccgcaggattcagggtgagtagatgggaagtggctggaaaggtctcctgaaacccagttgcttttcagctcagctacctgggaaagatcctctgacatttgttctctcatacacatcagggttgagtgaaaaaaaaattgcatacagaaagttaactacagaggctattcataaaattctaaaacatgcaaaacagtaatatgtattttcatggataataagtaaatggtaaatgcatgaaaacatgaatgcgaataaaaaggcatcaaattgaggagactggctgtaaatggagaagggccgggggcagggattggtgagtgctgcacagacagcttcagtcatgacttgttgatagtgtgttttgttttgtttttgtttttgtttttgtttttgtttttgtttttgttttgaactggagatttgctcttgtcgcccaggctggagtgcaatggcacagtctcagcccactacaacctctgcctaccgggttcaagggattctcctgcctcagcctcctgagtagataggattacaggcacccgccaccatgtacacctaatttttgtatttttagtagaaacggggtttcaccatgttggccaggctggtctcaaactcctgacctcaggtgatccacccacctcagcctccaaagtgctgggattacaggtgtgagctactgcacccaggccgtttctagtgtttctaacattctaaataaataaatcagatctaacatagtcatggggtaatgttgagatgcgactgaactcgatattattccccatacttttctgtgtgtttcaaacatttcttttttaaacgacatgttgttcttgctacacactgttaatgaatgaaaggacagttaagacaattttaaaagtgaaaaaaaggaaaatgttaaaagtgtagatcagccaaaaacttccagagattgtttcattaacagcatgtagatattggataaatatcttaagagagagggtgatgaacacattaggtaataaagatcgctgtttctctgtactttattaaaaccaaatagtcttctcattcccaaacaaccccaattctccatgatgagcttggaagtgagtttgaaagagtgctccctcatctaacacacagagagctttcccaattgtcagtgagcagagataacataggatgaaaaaaagacaggttcttcggtagagatctttgtgcatttcaggaatataaaggggacatatgtgtttacctgctcttctgctctgacaatacaatcataagacaaggtcggagtgtctaaactgtcctcaatatacctattactccccaactaaacaggccagaatcaaccatctcccgcaatcactataagagacctgaaaagccagtgcttgagtgtctgccaagttttgacattaaaggagtgtctttttactgaaaatatttcagagccactggactaaattatccacggttcatcacacatttaacagcttaattcacataccataagatccacccatttgaagtgtacagtgatttttagttgttcacatcttgagtggatacagttcagattcccaaccaatgaatttaattatttgggaaaaagtaaaagatatgtaatggaataagatgagactgtgatgggatttaacccccatttgacaaaccatgagatgtaaaattctgaattgatgccacagataaatgcaccaaccattactaaacataattcagaagcaaatctcaaataactcctcaacaatgagtggactcatacccctttgctgcagaatgccctcatgcgacagaagtctctctagagtttggaaatctttaccaacaaagaaaaattctgatgtattctcttccagttgaacgtcctcagatgacttttggcaggctccagagaatcatcccgaaggtgagtacctctcaaatctaaaggaccagagaacctttttcccttcatggatgtgaacactgataagagtgggagaatatcaaaaatgccctcattgcctctttctccccatgtctatcacaacaacttatgtagcaccgacggcttgataatactaacagttgtgatccttaatacttcttttgttttcatagtgatgccagatactattttaaggagttcacatggattaattaatttaatccataagaagacctctatgatgttgtttcttttattatctccaaatagtaatgagtcacacacttcggttgtcatccatataaaagccatgtgacttggcacaaatcttctaagttattggagctccagattcctagtccatgaagtggaagtaaagaataatagttcatgttatagaccataattatcagcaatataacaataaaatgaggctatcatggtacagagatgttaaagaattttcctggggcgcagtggcagtggtagtctaatccagagcttcaagccatttaaagctcattcacgtttgtatttgtttatgaagttcagatgttgctcactagggcttcaccccatagggcctgatggtgcttccattgagacacccactctctcaacaggaaggaccagctggcctctcttctgttaccggggccactcccatggcttaggaatcgctttgactgttggcccctccttgagctccttaagggttttgtctgcacctggggcatccgagaagccccagtcccagcccaggggatccctcagaggcccctgaatgagtgattctggaagtgcagattcagctctggtttagaaggtaaagggatctgggagttgggttgccagtatggagaacgaattcaaagaaggatccagaaaggtattcattgttattattattacatttgaacaacgtttacaagctcagagaggactttcccttagtctattttacatgtattattcactatttcataagtgaggaagttgagtaaaaagtagtttaagggccgggcgcggtggctcatgactgtaatcccagcaatttaggaggtcaaggcgggcagatcacgaggtcaagagatcgagaccgtcctggccaacatggtgaaacctcgtctctactaaaaatacaaaatttagtggggcctggtagcacctgcctgtagtcccagctacttgggaggctgaggcaggggaatcacttgaaccggggaggaggggaggaggagattgcagtgagccgatatcgcgccactgcactctagcctggtgacagagcgagactttgtcaaaaaaaaaaaaaagtagcttaatattgttggtcagtgacatatctcaatgcaaccagaattggtatgggcaccacctcactgaattccacattcaatgttggtgcctcggtagggtggtatgccatatctgttactgctttctttgctgcctagataaatttcagcaaaccatttctttccctctcccttccctgtattcatctccccacaccatctttcccagcagtgttttgtcccctctctatgtttttacatttactctctgagcagctgtctacaagcttatatgggatcccttgtattttatagaagttcttccttttttagacgttgtgaattcttagaatgctgtttttctccaaatcttctgtgtaccgcactctcaatcacatggagatttctgctgtttgcacgaatgtcagtcttaaaaaagtgtgaagataagcattctaatcctggaaaccccattcatttaggccattccttttgcttctaatctcccaggtttctcttatttaggcaagtgtaactctcccagcattgttgagaacattgattaaggtaatgcatgtgaagatgctttgtaagctctaaagcactatagaaatgtcactgattctgtttatctgtgaccttcacattataaagatcatgcccaagaagccagcagaggaaggaaatgattcgaagggagtgtcagaagcatctggcccacagaacgatgggaaacagctgcgccgccccgggaaaagcaaatacttctgagaagattaataagagatctggtaagaggaatcaatttgggaacaactcctctggcttttctggctatgttcaggtgtgtggactgggtgtgtggcatggatcccagacaagtctgggtccaggctgggctgaggagctcgcccagctccagatgagatgttagacatgacttccagagacacagactggagttgtcacccatataaaaaaccacgtgacttggggcaagtctttcaaattttctcagctccagactcctagtccataagatggaaataaagaatcatagttcataaattgtttggagacattaaatttaatctagaaggcctgatgacatgaaaggtgctcaagcgattctatcagtgataacctgggatcatatcttactcagctcaatgcctgatacccaatgcaggtgtacttcagagatattgcagattcggttccagaccactgcaataaagtgagtcacacacattgtttttcgattgttttgcagtgcataaaaacattatgtttacactatagtgtactctactaagtgtgcaatagcattatgtctaaaaatgtacataccttaattttaaaataattcattgttaaaaaatgctaacaatcttctgagccttcagtgagtcacactcttcttgttggtgtggggtcttgcctcagtgttgatggctgctggctgatcaaggtggtggttgctgaagggtgaagtggctgtggcagttccttaaaagaacacaacagtgaaatttgccacatggattagctctccctttcatgaaagatttctctgtagtatgtgatgctattcgatagcatttagccactttagaacttctttcaaagttgaagtgaatcctctctagctgtgaaagttttagatgacatctacttccaataaaaggctattttatctttattgaaaatctgttgtttagtgtagccaccttcatcagtgatcttagctagatcttctggataacttgctgcagcttctccaacagggtttgctgctacaccttgcacttttatgttatgaagatgacttccttccttaaacctcatgagccaacctctgctagcttcacacgtttcttctgcagtttcctcacctctctcagctttcatggacttgaagagagttcgggtcttgctctgaattagactttggcttaaaggaatgttgtggctggtttcatgttctatcctgatcactcaaactttctctatttcaacagtaagactgttttgctttcttattcgtgtgttcactgggtattagtattattatttccttgaagaacttttcctttgcattatatactattctttccttcaagaacttttctttgcatgcacagcttggctatttggtgcaagaggcctagctttcagcctatcttggctttcagcatgccctcctcactaagcttagccatttctagattctgatttagtgtgagagaatgcaagtcttcctttcatttgaactgttagcggccattgtaggattgctaattgtcctaatttcagtattgctgtgtctcagggaataggtaggcccaagaaaaggaaaagagtcgggaagcgctcatcggtggagcagtcagaacacacacaacattgatcaattacgttcgtcatcttctctgggtggagttcctgttacgcccaaaacatttacaaacaacagggtgactatagtcaataataccttagtcatacatttaaaaataactaaaagagtgtaattggattgtttgtaacacaaggataaatgcttgaccggatggataccctattttccatgatgtgattattacgcattgcatacatgtatcaaaacatctcacataccccataagtatgtacacctactgtatatccacaaaaataaaaaaaattattttaaagactaaaaaacaacaaaaacaattgcaataataacatcaaagctcactgatcacagatcaccataacagatacactaataacagaaaagtgtaacattggtgagaattcccctcaaaaaattacagtatctgcaaagcactataaaaatgaggtgccataaaacaaggtatgcctctgtgcccttaacaaatatgtgcagcatgaaaggaggtatgggtgaatgttcctgtaaatgaagacgttgggaatctaaacctgacaacggaaggagccagaagctaaaactttaattggtatttgtcgtgtattggtgtggatctaaggtctcagcctctttaagccagagaatgtgaaaaactggataaagaaggcccatgggcacttgggaggggggaggcatctcctttttttgagaaaacagagcctaacattcttcaacctacccagtcctcatcttccaactcttcttcatcataggacccaaaagggggagacatgcctggacccacagactgcgtgagagaaaccagctggtgatttatgaagagatcagagaccctgaggaagatgatgagtaactccgtaagtgaacctttggctcatcccccacatccctgcagatgtgctattctgttatggtactggtatcccatcttgtcatttgtttcccaaatcattcctttctcataattttctagtgtacagcattgaggctgaatgatgagatttcccatgctctttctactccctgccctgtatatccagggatcctccctacccaggatgctgtggcttcccaaaccccaggtcagccctgatatgtggccacaccttcctctagcctaggaatggataacccaggcgaggaagtcactgtggcatgagcagatggttcacttcgaggaaccatggaaggcgtgtccaggtcctgaggtagggcagaatcagagtgtgcagggtctgcaggtctggagaagttgagattgagttattgggcagtgggaactcgctgtcacttactttccttctctcttctcgcctcagcctgggggatatgacacatgcccatgatgagaagcagaacatggtgacctttcacgaacatgggcatggctgcggaccctcgtcatcaggtgcatagcaagtgaaagcaagtgttcacaacagtgaaaagttgagcgtcatttttcttagtgtgccaagagttcgatgttagtgtttccattgtattttcttacactgtgccattctgttagatactatccttttcaatgatgagcaagacatacttaatgcatatttcggtttgtgtatccatgcacctacgtcagaaaacaagtattgtcatgtattctctgcatagaacagcactatcctcatctctccccagatgtgactactgagggcagtcctgagtgtttaatttcagacttcttcctctgcatttacacaccacacaacacacacacacacacacacacaccaagtaccattataagcatctcccatctgcttttcccattgccgtgcatcctggtcaagcccccctcactctgtttcctgttcagcatgtactcccctcatccgattcccctctatcagtcactgacagttaacaaacctttgcaaacattc

SEQ ID NO: 2388 - DNA, 112501 bp, Homo sapiens
aaggagtacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttcatctcatccccctattctacaacatcacagattcaaaatggctcattagtgtctagaaaacaactggttcagtcgtcaactgaaaagtgctctttccccattattaaaccattttctccttagaggagatctttttgattgcccttagcttcaaatatcttttgctagtgtcccatcaaaagtggagatataaaagagagcaccaaagggtgtgtggtggttcatgtatgggacctgtagttgacttacagtcagcatcagcaaaaataatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagtagactcacattggcaatgaaaatgaaagtgtcataatggaagcaaagatccaccacttagagcccctgctcaaggcagaactctacctcagtgatggggaatgctgttgggagacagcctgcagctgtcacctccttcagggtccacctcagctgaaaagagctcccttgcccaaggagaagccctcttccaagtggcccatatccacccactggtggtggcagggtttgtataaaggtcctaccctttcagcccagcacaggactgggctctgagggacggtatatactccatgatgacccaagtgactggcagaggctgtgtcaggcctgtgttgcagttccacttccccagggccactccccttcagcagggatccctagtaaaatcctgcaagctaaactccaactccgtgaatgctccctgggaacctaacctacaacaggatgcgactccactggagagcacatatcactttatggaaaatgcagagcagagccgccatatagtccatagaggcaatttggtcttgttgagatgaaaaaatgttatttgttcctgaaattttcctgaaaattaaatattttaaaagcgggggaagagaaacgctacattcactttcaactcctgcagtcccttgttgagatcctccagtgggactaacgacttcgcaggcagcggagaaccccagctaggagaaaaggctctggagccagactgcctggattttttttttttttttttaaccagttctgtcacttcgtaactgtttgagcctaggaaatttatttactatctgagccttggatcctcctctgtagggggggataaaaatactatgtacttcagaattatattttgaggattaagtggtgtaccatatatgacacttagaacccagcctggcacacagtaagtgtgcagacatgctaaccatgagcaagtgtgagaagctggggcctcccttttcttccacgttcaatggacagaaatgggggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctggccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggtgttccctgaggatgctgtcatctgtgactgtctgctcttctgagaatgtcattgtgcttgctcgctccactctgggggaatccaaattaactgatgtggactcattttaaagtcaaggaagataaacaggtaactgctttctcaacaagacaattactggaattcacaaacatattattcattaaattaaaccagtatttattgagtagtctatgttagatacttacaagcattatgtcatttaagcctctcaaaaaaccctacacagtaggttttatctcattttagagatgagctaaatgagttagaagttagtgaatgtcaccaggctccccagctggttcatgacagaacctgttggactatctgcaggctgatgccagagcccaggcctgggattactccctctccttctcccttccttcctcccagcattctgtcatttttctgttctcttttctacatttactgagcactaatgtgtgccacataccatcaaaatcttatccctgcactccaagctgatttcaaagtaggtaggaatatcacctcttctagacaaaaataatgttcataaatcatcagttacaaaacttagattctgccttcaggattatattcaagaaacaagcaaaagccaggaaaaatcatgagttttacacatagtaagatgctgagtaaatatttggggttggcagacactgctggcccagctggcattacatttctgttagccctactccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccacaggtttccgaagtcaaagcctgtgggattagaaagtataagaatgaacgaattacgcatacaacaaaggcctaggattgaccaatctttctaaaatggaaaagtttaagtgtggttcctcagggatactgtccctcctgacatgaccagaaggtgggagtgcacggcaagataaaggaggctgcaagggtgcacacgttttccaagtggttaaaagtcaagttaatagagctgtacttgatgataccaagtcctattctgatgaaattggtaatttgtaagataaaacaggtaaacatacagtttgagaaattaaatcctgtatatgatgtaatatagattaaataggataaaggcacagagatcaaatttttagttcgccatcaccttttcttccaagcagaaaagattttacaacgtactcgtgtgatacctcctgccccattgctgacaacctggctaattataaccatatttaggcttatggacgacagtttggcccacaggagtcagaagacctggtactacaaactctggcttctaatgaatcttcaatttgggaaagccacttctcctcctgggtctcagcttctgcatctgtagaatgaaggcacaggccaagcaacaaatctctcccttagtactccagttaattgaaggagttaaaaaagacagacaggactcctggggaccctgctcattctgagagtctgttcacaattcttgtgtttttcttgccttatgaagcagaagtagcttgttacaagtagaacaccacagctgcactgaatgatggaaaaacctcatctttttttagtttccctgcccagagctccttatgaaagagtaagtgatagtgttcctatcatgcagttccttaactttgcactccctgcagagcctctcagctctgtgtaccccaaacatgcaagggcagtgaactgggggctcctccacacataatgaaactgggctaattctcagcaggaatgctggcacagttcaactctgactcccatcctcgtttgaataggcctcaagattgatatcaggagtatccctggaagagccacagtgtactggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagttaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttgcaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcacacaaaaccacttgccctttctggaacatgcctgtgtgtctttgcataagctgctccatctacctgcagtgccttttcaccccttgcttacttgataaactcatttttacagagataactctttcacctcctctgagaaggtagctttccttccctaccctccctacagggtttggtgttccttctctgatctcacagtgctatgtacgtaactctcacattgtgcttgtttaatagctgtctccccgactacaatgactgacttttaaaaaaatatgcatatgtacacagattttaagacagggtctcactctcttgccaaggttgaactgtagtagtatgattatggctcactgcatccttgaaattctgagttcaagcaatcctcccaactcagcctgagtagctgggactacaggcacttgccatcatgcctggctaattaaaaaaaaaaattggtacagacagggtctcactatgttgaccaggtggtctcaaactcttggcctcaaggggtcctcctgcctaggccttgaaagcactgggatgacaggcctgagccaccagggcccagacaaactttcaataatttgttaagtcaataagccagaatacgaaaattgcttgagagcagtggtgtgatcacggctcactgcatccttcaactccttggcccaagcaatcccgccattcagccccttgaataactggggctacaggtgcacactaccaagcctggctaatttattttttatttttttttgcaaagactggggcttgccatcttgcccaggctggttttgaactcctgggctcacacgatcttctggtcttgatctcccaaagtgctagaattatgggcgtgagccatcgtgtccagctaatgttattgttgattgagcacctattctgtctacttgttttcacaaacattattttatttaatcttcatgacaaaactgggaggcaggaattattattctattttataattggaaaaaaagacaagacaagactcacagaggtcaagaaatgacttgcaaacaggcacccactgagtggcagagccaggactggtctcagaatgtgcacaccaagcctcaggctcttctccctcctcttctccagaccttctcctgggaattggttcccctttgctgtgagtagcattttgacagttaaatgcatcatctaccactaacatgttcaactgccttgtacacttagccatccttttgttacataagactctatttcaggtaagctttaaaaatcaaggttttgattgtcttggtctgctttgataggaaaaagcatggagtagtcaagccaaaagtactctatgtcccattaactaggtgagctaaagggatcaacaccttaggacctgctcaaactcagcctgagttttggggagaaagctaactgcagaatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacctcccctaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgcatattgttttcctgtactttattgaagttgtttattgacttgtgtttataagagctcttttatatttattaaatatttacatgcactgcttatgtatttagctgcataaggagaaattaatcccatctttaatctgagtaaagttgttggctttctaaaggccttttgctttagtaaaatggaaagcagccacctcaaataagcttcttcttgttaactgttccagacactttgtaatgtaccaataggtcccatctccctaaggtaatcacagcagaagccatgttctaatccatatttaagtgacatgttcactctggaagaatctatacaacttctcaggtagcctgcaaagttagaataaatggataaagaagtaaataactacagctgaaaaggggtttggggattatgtgatcgtttgatttgcctgtgaaaattctccatccaccactactaatatggaaattacaaattggcttttatattctagacaaatgccgctctcccttaagtcctttagtgtctgccaataatgtcattccagagaagaaactaagagataacctagaagtcacgggattagttcccctccaaatgaatgtaagcctctctacagagagagaagaatcaaatgtagattctgttagaaagtttagctgaaaacttgctctattcacactgtaataggctacttaatattttaactattcctaaaagcaaaacaattcaaagacccaccttccaccctattctctttcccaaattctcccttctctctctctctctcagttccctattgaatatctcagtattggaagattgcataggtagttgttaatgttttatttgtgaagataaaaaaattcctgttgttataaagctataatagtcaaaataatgtgatacttgcgatgcaacagtcacacagattactgaaacagaacagagagtacagaaatagacccatatagggccgggcgcagtggctcatgcctgtaactttgggaggccaaggctggtggatcacgtggtcaggagatcaagaccatcctggctaacatggtgaaaccccatctctactaaaaatacaaaacattagctgggcaaggtggcgggcgcctgtagttccagctacttgggaggctgaggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggatgtaaaggagttcaaagtcttaaacattgctggtaggaatgtaagatggtataaccgatttggaaaacagtttggcagtttcctgccctaccacacaatccagccattccattcctaggtatttacctaagagaaaaggacatacatgtccatacaaatatttgtacatgaatgttcatagaagcttttattagtcccaaactgaaaacaatccaaatgttcatcagtggctgaatggataaacaaacatacaacaaatggataaatccaaatgttcatcattggctgaatggctattaaacctgatacaggttgaacatcccttatcaaaatgtgtagaaccagaagtgttttggatttgggatattttttcagattttggaatatttgcattatacttaccagttgagcaccccgatctggaaatccaaaatccaaaatgctccaatgagcctttcctttgagcatgatgttggtgctcaaaatgtttcaagttttgggggcattccagatttcagattttttgaattcagaatagttaaactatatacccataaatggactactacttggcaataaaaaagaacgaattgatatgcacgacatagacagatctcaaaataactgtgctgagtaaaaacagctagacaaaagagtatatactatatgttgccatttatataaaattctagaaaatgcagataatctatagtgccagaaagcctgggaatgtgggggtgggggtggagagagagataagacagagagattacaaaggggcactaggaaacatgtgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctacaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactctcacttatgaatgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaaatggtatttctagttctagatccttgaggaattgccaccatcttccacaatggttgaactaatttatactcccatcaacagtgtaaaagcattcctatttctccaaatcctctccagcatctgttgtttcctgactttttaatgatcgccattctaactggtgtgagatggtatctcactgtggttttgatttgcatttctctagtgaccagtaatgatgagctttttttcatgtttaacggccacgtcttcttttgcgaagtgtgtgttcatatcctttgcccacttttcgatgtttttttttttttcttgtaaacttgtttaagttccttgtagagtctggatattagccctttgtcagatgagtagattgcaaaaactttgtcccactctgtaggttgcctgttcactctgatgatagtttcttttgctgtgcacaagcggtttagtttaattagatcccgtttgtcaattttggccattgcctttggtgttctagtcatgaagtccttgcccatgcctatgtcctgaatggtattgcctaggtttttgtctaggatttttatggttttagttcttacgtttaagtctttaatccatctttagttaatttttgtataaggtgtaagtaaggggtccagttactgttttctggatatggctagccagttttcccaattgcttggattttgttaggtttgtcaaagatcagatggttgtagatgtatggtgttatttctgaggcctctgttctgttccattggtctatgtatatctgtgtttgtaccagtaccatgctgtttttgttactgtaaccttgtagtaaagtttgaagttgggtagcatgatgcctccagctttgttctttttgcttaggactgtcttggctatacagggtcttttttgattccatatgaaatttaaagtcgttttttctaattctatgaagaaagtcaatggtagcttgatcgggatagcattgaatttataaattactttgggcagtatggccatttttgtgataccatgagtatggaatgtttttccatttattgtgtcctctcatttccttgaggagtggtttatagttctccttgaagaggtccttccaatctcttctaagttttattcctgagtattttattctctttatagtcattgtgaatgggagttcactcatgacttggttgtttgtctattattggtgtataggaatacttgtgatttttgcaattgattgtgtatcctgagactttactcaagttgcttatcagcttaaggagattttgggctgagactatggggttttctaaatatacaatcatgtcatctgcaaacagagacaatttgacttcctctcttcctaattgaataccctttatttctttcttttgcctgattgccctgaccagaacttccaatactatgctgaataggagtggtgagagagggcatccttttcttgtgccagttttcaaagggaatgcttccagcttttgtccattcagtacgatgttgcctgtgggtttgtcttaaatagctctaattgagatatggtccatcaatacctagtttattggatttttagcatgaaggggtattgaattttattgaaggacttttctgtatctgctgagataatcatgtggtttttgtcattggttccgtttgtgatatattacatttattgatctgcatatgttgaaccagccttgcatagcagggataaagccgactggattgtggtggataagattttttttttccttacagacagaggttttattgtgtttggtccacagtcatatttcacattatctcatggagcagggcccctgggtggggggtccctgtgcagtacttggaggggcatgtggccgggggagatggagcagtatagctggtcaggcccagaaggggagaagggctggggctccttaagacctactaaggggccgggcacggtggctcacgcctgtaatctcagcacttagggaggccaaggtgcgtggattacctgaggccaggagtttgagaccagcctggctaacatggtgaaacctcgtctctactaaaaatacaaaagtagccaagcatggtggcacatgtctgtaatcccagatacttggggggctgaggcaggagaatcccttgagctcaggaggtggaggtgcagtgagccaagatcatgccactgcactccagactgggcaacaactactaagaaaaaaaccctactgaggccacggtggtggtgtggggagttggggggattaggcccaaccactcagcatccacttccttgtacaggcctcactttccccactgggccctgaggcaggtctgaggtctgttggcctgagggtcctagggaaatccagccacttgggagcctgagatatttagcatcatagacaggccccctttcccaggggactcatttcccagcaccctctccactgtccccaccccattcctcaggaaaaaaaaatgtatttttcttttgttaatgcatcctgaaacttttgcgggtatagaaaccacaaactgatcggctgacaaaagtgggaagaggcaaggcaactggaaacctccgggtactggttccctccaagcccaggtctcttctccccggcacagctctgctggcagcctggacgtgccagcagggaccctcaccatacacatattgggatatggccttgaccccttctcctccacagcctggtggctcattcctgcgaaggaccaaggcaagggggaagaaagccctgctgcctgattccacgttgccactcacagaccctcggttgattggcagcactgaacaggttaagaaaaaaaagatgaaaacacagaaaaacccaaaaacccagaaagggagataatgtggggagagagtgtgctgggagcctcagtagccagcctcctcctggtagtaagggggatattcagggacctctcctgggcccaggcagttgccagcacccaagggagccccgtcagccactgtgcctggcaggcagtacttggggtcacatatatgctggcccaggccaaagacctggctactatggttggtaccctgggtgtagcccatctgcagggacatggaggaattaccacacttgtcggttcccagcttggtgtcacagatgtgctgccgcgtcccaggagctgtcatgctcacctggctggcacagttatttgtacccatctggaggccaatgatcgagtggtccatgggggggcaggatgtgattcttggggtcacacagatgcctcttcacgccatacacggtcatgcccaactggctggtacatttgttggtgcccatttgcagcccgatgacgcactggccagccttcatggcggcgtcactgaagttctgctcctgcttctctgagtatttgatgccaatgtccaccccgctctgcggcctcttagtcttgaccttccctgctagggcaaaaagagacacctgcatgtgcctcatgttcccactctcaaacaggttgttggccttgaacaggtccatggggttcatgtcatagctgactacagccttgatgaagttggagaggttttccagctggtgccacttctgcatggagtggttgatcttggggaatgaggccggctgcagcttgttcatgagtatgcataagataatcccgtccttcaggctcttctggaagtcaggctcaatggagatgcaggtgagtcccttgatccagctgtgaagctctgcctccttctgggggtcatatttgggcaggagccagttcttgacctcggctgacagcccatactagacgcctttgttgaactgcgtggaactcatggctggcaggctgcgggatggggccacacgggacaggggtggataagctttttgatgtgctgctggattgttcatcagggatattggcctgaaattttctgtttttgttgtgtctctgccaggttttggtatcaggatgatgctggcctcataaaatgagttagggaggagtccctctttttctattgtttggaattgtttcagaaggaatggtaccacctcttctttgtacctctgatagaattcagctgtgaatccgtctggtcctgggcttttctttttggtgggtaggctattaattattgcctcaatttcagagcctattgttggtctgttcagggattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaatggaagaagacatgaaataacagactaaacaattcgccaaaagtcacacagcaggaaagctggaatttgatccatgatttgtggatcaaatccagtgcctcatctattataccacacttccccaagcattaattgtcccataaacttcattttaaaaataaatagaaaacaatgacagttaatatttactgacactttactaagaattagatccagtgctaaacactctagatatactagcttttcttagtccattcagtttagctataatgtcccagactggatacctaatagagaaaggaaattcatttcttacagttcgagaggctgggaagtccaaggttgagagacccacatgtggtgaacgacttcctgtggtgtcatcccatggtgaaagatggaagagcaagagacgacaagacagcacgagattcaatgtgcaatctcaagcccttttataatggcattaatctattaatgtgggttaacagattagtacccacctgaacacccctcactagtgcccatctctcaacactattgcattgtagattaaataacaaacacactctttctggggaacacattcaaatcatctttcatcctcacaatccatgaggtaggtacaatcatctctaatctacagctgggatatctgaggcctggaaagattaaataataacatgtaatgtgaatgaatccactcaagtataatagatgtttaagttgtctagttttctgatatgactgacatatttaatcttgattcctttagtatgatttgaagactatgttcaaaacttactgaaaaagtgatgatttcctttagttggtttagagagacgcaaactatagagttgtgatatactattctgtcaaactttcattttaagaaagcactgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaagcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatctgcagctctggtgtttaaatgactgttaaaagtacaactgcaggaatgacaacaaaactgcattcgctattgaaaggaaacagtgaaacctaatatcccatcctaccttccagcaaaatatgtatcgagcttttacaaagtgctgattctttaatatctggcataggaaatgatgttgagaataaatgataccactatttgttgattatctgccaatatcaaataacacattgtgagtccctgaggactcacgagggtcctcacagctagcattcctttcctcgaatttctttttgtattttggttcccataaaactacagttccattttctccaaagagattaatgttaagagaaaaggaagacagccttaaattcttgccagttgtgactattaacaactgtggaattaagatggagaattatctttttcttaaaatacttttatctttgaataaagtagcttttcattcaaatgtaaatatcttcaactgatgacacttctcctagatacagatacatttgaaaattatattaaatgacagaactttagttttgtccttgatcttatcatcttgaaaatcatgacatttttaggtaatgatgcagagaattctcttctctccatgctcccataacacaccacactctaatagttacatattcacagattatctcttgggctagactgaatcacataaaacaccacctttgcctctccaagatctataagtgcttgataaatgtttgtggaattgactggaaacaacttaagttttaaattttcatgtcctatatcagacagtgtcaaatggaaaccctgtattgtaacaaatggaatttaaagaggctaaagatgcaattttgaagtgaattttaggaaaaaacggagttacaatgtgtctatgacctaagcatgctgcactgagaaattatccttcctaagtacctccattaatatgtcattccgaattttaatggctctcccctatgggagggtgtatagtcccttagcctgggaggcagtgtaccactgtaatatggaatataggccctgggtgtgactctcagccctacaactaactagcatgtaaccctgggcaggtaatgtaacccctcttagccacactttgctcaatgctgtagggttgctgtaataatgtattcaaagcatttagcaggtacttgacacaaagtaagtgctaaatcaatgttggctattaatatccaaaatgtaaagcctttaatactttgtaaaattaattgatttttcacagcttgagatataactcatataccataaaatccactcttttgatgtgtacaattcagtggattttagtatattaacagagttgtgcatccatcacaaccattacttctatctgaggacataaataccccaaaaagatacttcatattccatcagcagtcactttccattctcccagtcctttgcaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatccgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctatactcataagatgttggtatatagttttcttgtgatatctttgtctgtggtatcttctacatgttggccacaattttttgacccagaattatttccaatgccttgatgtgcatattatttcccagttcatctgactcccaacgtttctccccagtcccttcccaattccgttattccactaagactttgtgttctcctgcttcgagttgttgactaacactgccctttcttcccaattcactctacttatctatatcctacagaccctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcaccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatattaattaattaaatcaagggcttttccaaatccagtatgtccttatggttgtattcctaatactttggtttgaccaactgaagtaaataaaatagtaacctcattaactgtaaaggtgatctgcatgaaacctaaagaaaatcaaacaatatcaaaattaatcaaaaggtgccagagagacttctgcttctaattgtaatggagtaaccgacactggacttgttttaccattataaacaactagaaaagtatatgaaattgttttattcaaacattggatatcaggcagtatgggactatgaatctagagaaaaggaaatccttttgtgcctaaactttctagattgcagtatggtatgaggagaccaaagcagaatatgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcaggtgatccacctgcctcagcctcccagagtactaggattccaggtgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcggaagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtagactgtgattgaggtgcatattgtacacactaaagcaaacactttaaaaagaggtacagctaataatgcaaaatagaataaaaagagtggtaaaattatctaactcaaccaaaagaaggcagacaaagagggaaaatatggacaaagagaaaacaaatcaaaatgggggattttagacccgaccatatcattaatacattgaatgttgaacaacaaaaatgaaaacacgaagagtagatattattccatttatatgaaattctagaataggcaaaaataattaaaaagaatcagtggttgccagaagccaagggtgttacctgcaaagaggcatgagaaatctttctaaggcatggaaacaatctacatcttgattcggatggttacacaggtgtatatacatggtacttaaatgggtgcattttattgtatgtaaattatacttcagtaaagtcatttaaaacgttaaaagatcttcagtggcaaaacagatttgaacccaagctgccttgcaataagcacttatggttttatggactcactatgtggcttcttgtctggcctgaaagaggagattccatttattcaatttaacttccactacctgatattgttatgtgccgggcgcagtggctcacacctgtaatcccagcattttgggaggctgaggctggtggatcatgaggtcaggagttcaagaccagcctagccaacatggtgaaaccccatctctacttaagataaaaaaaattagccaggcatggtggtgcgtgcctgtagtcccagctacgaatcacttgaacccgggaggcagcggtttcagggagccgagatcacgccattgcgctccagcctgggtgacagggcaagactccatctcaaaaatgttactcgtttttagactgaaatatcttggaagaaaacattaaatgctagaagttaatttatcaagaaattcctaacacctatatgatgacatcagtgatgaacattacaacaaataattgaagggatttttatcatattatatcatattcctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcaggcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggacggagcttgcagtgagccgagattgcgtcactgcagtccgcagtccagcctgggcgacagagcgagactccgtctcaaaaaaaaaaaaaaaaaaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaaccaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatcgcttgaacctggggggcggaggttgctgtgagacaagattgtgccacttcaatccagcctgggcaaaagagtgaaactccatctcaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgatttctggtttcaatttccttaaagtgaagtaaggacttaagaacatttgcaaagcaattccaggtgcccattctatctaggtttatatttttccccagtcttttacagttgtcttaaattgattgcatctttagtttttcttagcatctagcctttagcaaatattttcaaagcattaaacttcagaataattaataattccctttcatactcacattttggtttaaatatttcattaaactgcaaaattacaataacaaatacaactagaataaaatatttggaaacaaacaaggttaactcgacaaacacaaaactcagtaatctaactgaattaatattcaagtttattaataaatcttttattaaatttactactgtgagtcagtttaaccaagtataattaactctgtatcaactgataaaatgtttctagatctgtgctgtccaatacggtagcacgcatggcaatggagaacgtgaaatgtggctagtctgaagagatgtgctgtcaatgtaaaacacataccatatttcaaagaatgcatatgaaaaagaatgcaaaatattgtattaataacttatagtgattatatgttgcaatattttgaaaatactggattaaagttattaacattaatttcacgtattttttaatgtggctactagcttattttaaatgacaaatgttgctctcattctattagatagcactgttctagacctgcggacatcctttgttcaatgatgatatcatctgtgaggttctacttgaaacaatgaatcagactttcctatcatctgttacctggatcagagatatttgagtaacatttataaatcttcttaagctgacttgtgactctgtaacagggatctgtaaactatggcccatgggtcaaatataccctgctgttttggtatggcctacaagctaaaaccagtttttgcatgtttaaatgtctagaaacaataaaaagattagcatttgtaatccatacaaattatgtaaaaattccaatttccatgtctataaataaactttaattggcacatagccacactcaatattatctatgactgtttggtgatactatggcatggctgagtagttgcaacagagaccacgttgcctccaaaatttacatttactatctagccctatacagaaaaaaaatgtgctgagccctgctctatatcatctcttaaggttcatggggtatagtgagttgccaattgcacctaccggacctgtccaaacaatgagaagggaaagcttgtgtctccattcttatccttaccagagactagtttagatttccagcttcttaacttgcttctgccgctattcaacaaagtgtctagaaccccaccttctgggatagttcttacacagatggtatcacaaaaatgctcagatatctgtggggtcaaatggtccctgtgtgcctttgctttcacatccaccagtgttctatgacaccaatgttatcctttgtgggcttgggtactcactgcccttttggtgtctagcctatgggtactagttttattgtttttgtaacccctcaactcatttgcaagactgttcctcaagccctggtttttcagatacctacctcagtagaccctgtgaatgcaatcttgtctatgccaatgtgagaagctattgctgccccagccgttggcccatatcctggcaaaatattgatgaccccgggaggaaagccagcctaagaaaacagaacaggaggaaacgtggctgatgaaagctgatgcatcatgttaaatgagatatgctctagtaggctccagctgtaaggggagtcagaagcactcccgaagtccgtttctcttacctccttgatgagggctcccatgtagagtgcactgagtggtgtttgctctgctggcttaataactactgtattgccacagcacaaagctggagctattttccaggcaaacatcagcagggggaagttccactgaaaggaaaaaactcaaagttgatagatggaaaaacattcttccactactttgttttcaagctgtgacttctcatatttctcaaactagtcctcgacataaatcttgtccactacaaagtacagatgtttggattttcaattacttcattaagaatagaatagcactgaccttggaaatctctccttttctctctgaccaaccaattactatactccaactacccaccaaaagaaatcccactgtgaaaagggagttttgttacttctttgttttgttttgtcactgtttttatgttttttttaattaggctttggttccaataagttctcgtgtatgaaaacttttcttgcatctgagatttttacatcacaattttcacactggtatgaaagctcttcaacatggaaaaactagaaaattctaactgagttgtagttaagtcaatgtgtatttcaaggtagtactttttctttagatacatgcattgtcacaaacatatatgattacaaaaaataaactgcatatactgatgagtatgcaaaaattttcatttgtctcttttccactgtaaaagaagctattggagactacagtaacatttacatgagtagatgaggttggggtctaaaatggtttaaactgattttaaaaagatattaagcttgtattgtcataagctcaggcatgagcctcagtactatcaggtgtcattgataatttcattaagaaagaaaacagaaatcctcatcccctggcttcagcccttgaccacaatgtgtttctgcctgaagcatctcagctgccatccttcaaggcttctcactggctctggcaagcttgcaaaaatatacaagtgtcttgccttcaccaaacacccaatttcttttccccttagttgtttataaacttgggagtccaccgtaatgttttaattccatctacagtgtataaatcttaaagtgcagtaattgagccagagctggctgacaagcagctcttgtcctgtcagtgaagctgcagcgttgagagtctgggcaagggcaagaaaagtaagtttgaatcctacgaggaaggtgacagacctcatcccagagctggtccaagtaggatttccccagggcctttaagagcaagagaacttaaatcaaacctctcattttcccttggcattctctaataaatttcacagtaacctgggattcatcaattattcaaataaatattatatcttccccacatctttggttcccaatgccaaagattatcttgagttatactactgtactttgaaaaaagaaaacttcttgtctatactgtaagagtttactttgagcatccccttgaaatccctgccagaactattagctagtactgttaaaagctatggtcatgttttgtattgtaccaagggtgtgtatgagagacagacaggaacaaagggacaatgtttaatgttccaatccaaacactaagcactacatctatttctctttacaagacacataacagctcggcatggtttcaattatgactgtgacgttaactgtagtgctgtgtcttctgtagcatcttctatctagattcttgagaaaagaaacagtgggaaagaatgggattaaaagatcatataaaataatatgcctggaaggatggtgagtcacagttctaaaaaataaacaactataacaaagcattaattttccataagcagaatggacataataaccaagggcaggttattaatacactgtgctttgcttattttaatcatgagaattccatgacttgagaattcaactcctggtaacagagctgaaaccctattaacctgttcaaataagcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggacgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcatttcagctaatctgatagctggaaaactgcaacttgttttgatttatgtttaatgatagagtgaacatcttttcatgcttatattgtttgctatttttctattgggttattctttttagccatttgaagagctctatggatattaaggaaattaggcctctgtcataatattgcaaagatttttccccaatctgctacttatctcttgactttgttttatgtatattttaaatggaagaaattcagaagtaggctggattctgcaactgtatgaaattaatttaaaatatctattacgagaaaaaatagcgaagatgttgcaactgtccataggatgacagtatgaagtctgagtaatactttaaacatcaaattaactatttagctttgtatgcagataactaaagaatcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattccccttgaaaactagcacaagacaaggatgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcataattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatcctaagcaaaaagaacaaagctggaggcatcatgctacctgacttcaaactatactacaaggctacagtaaccaaaacaacatggtactggtacaaaaacagacacacagaccaatggaacagaatagagaaatcagagataagaccacacatctacaaccatctgatcttcgacaaacctgacaaaaacaaacaatggggaaaggattccccatataataaatggtgctgggaaaactagctagcaatatgcagaaaattaaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaacgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctactatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcactttgcattttcacgtggatggtgaaaggtgacacccctagtctgatctggggtgcctgacaaacacaagagctaagccttctgtgggcaccttcagctagggctaacagcaccccagaagtcattcacagctactaagaccctactatgaattccactgaacttctaaatcagggttaccgtaagaccagttataaaagccatcttcataatttttgccatttccaagtatcatttgctctgtcatttacttaatttctgttaaattaactcacctgttagaaatatgtaaatagctacctgttagccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagaccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaagaatgaaaacactattagaatttctgtagagccttataattttcacatccttatctcattttacactcaaaactctctgaaaaaaatagagcaactatcattatcagcatcttataaacagagaaaatatggcacagagaggttaagtccaaagtggcaccactggttgaggctcctggacttggatctgggtcttcagacttcaagttctttacccataaaaacatattaatgactcttgtgaggaaggtgttggatttaggtggataatcacaaatcacagaattagagtataatgtcaagaacaatcacaaatggggtaaaaataaacaaagaaaaaacctcaatgacaactcttttgtaatatgaacacagaacacatggaaacttgttataaagggaacactacagagaaacattccctggaataggtgagcccaggactaagcgcctctctccctttcatctaggcagagccaactcgaaatggagacagtgttaattctccctctcatctatacctcagatgatacataatgagtactcttctctgcctagaaaaaattaaagccaattttccatcttttatgctaacaatggtctctcagtatggcaggatgacttagaaggttgtttccttcatttctctagctttgtgctgtaagctcaacagcctgatataaaaacagtctccacccaaattcagatactccattgtagggtatgaatggttttggatcttcttagcaaatatgagggattacagagagtgctcagacttagcataaaaaaggactgcatttgatggggacaccagaaaatgttctggataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattatgctatgaatttggctgagctgtgaattaaattttactgagtatgtgtgcattgagccatttctataattatattaagaacagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaatttttagtctcataaaaatatctcgcattggcacatcctatatattaatataaactagagtgagtatgactaagcaatctgtaaacagtgataaaatcagaagaatctgaaatgtgccagaaattgagaaatttgtcaaatatggaagtcaaatagcttccaattataacactaagaacactacaagaactgtagcaaattttatatacctagtaacaataaaaacgattttattcaatagcataaaaatctgtaacacaattcagtgaatgaaggtcatcttccaatccctaatttgtagacagaattacctttcaaggagctggcaattctttgatgaccacagtattaaaaaatgagatgattacattgaactattccattatgtatgtactgtagcagattcccatcatgttgacgttgaacagacctcacccaacattttataactatgatgataaactctataaatgcctatacaaacgctgaaactgtatgttagtatgaagtgtactgatgcttttcttcccagaagtctgctggtagtttctaagaagttagattatgttcctgagtctgtcatgaagatagcttagctctacgactattccactacatgatcgtaacaaaagttagtttacttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatctttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagagaagaggatttgaatacaggttaaaaatactcaaaatggagaaaacaatacttttctttagggctgctataacattagcgataatgtaacaggtaaaaaagtgttccataggtcatagtaatgattattatttatcatcataattaggcactgccatcgtaaaagggtcaaagcttaggatttatggtcagagacaatggctccattgggtaccatggcaggaaataatggatagtgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttatggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctcacttataagtgaaagcatgtggtattagtttctgtttctgggttatttcacttatttcagtataatggcctccaaccccatccatgttgctgcaaaagaaatgatttcataatttttatggctgtgtagtatcccatgatttgtgtgtgtgcgtgtgtgtgtgtgtgtatatatatacatatatatatatattttatccagtcatccattgaacagcacttaggttcattttatttacaatagcccctccaaaatacctaacaatatttaattaaggaggtgaaagatctctacaagcagaagtacaaaatactaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaaccatggagtataattcaatgttgtaaagcagtcttacatctaaaaatttaacaacaaaaaaccctatttcaggttctttttttatgggtgaccaaacagaactgtgttactatctctgacactcactatgaaagccccctttacccatatgattaggatctaggcagggagatccccacctcaagtgttccagaacatttaagcttcataaatgctatcttgagaaaagtaggctctagatacagtcgattttcattatttgtggattccatatttaaggacttgcctactacctaaaatttatttgtaacccaaaaataagtacagagtgttctcagagtcatttacgggcatgtatatccaaagcagggatttttttttttttatttcaatagttttgggagtacaggtggtgtttggttacatgaataagttctttagcagtggtttccaagattttggtgcatctgtcacctgggtagtgtacactgtacccaatatgtagtcttttatcactcaccccactcccatccttccccaaagtccattataacagtcttacgcctttgcatcctcatagcttagcacttacttagaagtgagaatataagatatttggttttccattcctgagttacttcacttagaataatggcctccagctccattcaagatgttgcaaagaccattatttcattctgttttatgtcagagtagtattccatggtgcatatttaccacaccttctttatccactcgttggctgacgtgcagttaggttggtaccatatttttgcagtttcaaattgtactgctatagacatgcatgtgcatgtgtctttttcatataatgaattattttccctgggtaggtacacccattagtgggattgctggaccaaatggtagtgccacttttagttctttaaggaatctccatactgttttctgtagtgattgtactagtttacattcccaaccagcagtgtgtaaaagtgttccctctcaccacatccacgccaacatctattttttttatttttaaattatggactttttttttttttgcagtagtgaggtggttcagctgtggttttaatttgcatttccccaaagcagggaaaattttgagtcacctgatgcacaaattctcagctggggttgagcaaggtgacactctgccttcttgcttcagctctcatattgttaaaaaaaaaaaaaaaaagtgtccttttttgtggtctgtttagtgccacatttttcatatttttgtgccttttgttcacaattttgctgtttaaaatggcccctaagcatagtgttgagtgctgtctagtgttcctaagtgcaagaatgctgtaatgtgccttacagagaaaatacatgtgtcacacaagcttcattcaggcatcagttatagtacttctgtctggttggccatgagttcagtgttcataaatcaacaatatatattaaacaaagaatctttcaacagaaacacataaatcaaggccattctctgatcagcagacaagaatgttgtgatcagaagctcacaggaacctaatcttttatttcccctaggagcaatagttccatatttgctaattcagtgttcgtgacaactttataaaacataactactatgaatgatgagaataaaccatatattagtataaaaatctgcactggggtaaagacttcatcatattagtataaaaatctgcactggggtaaagacttcatcagggccaccttcctgccttgctgaaccaatctccataagaagagaatttatcatggcttaggcagaacaacacttaagtttgaatctcacgtctcccacttactagccatgtgaccttctacaagacactaaacccttgcagtcttattttcttagatgtaaaatgggtaaaataccatttaaaatccagactatctcatcagatcacacacagaatcacatagatattgtacataaaagaatattttatacttttaaattctatgcaaatataaagtacattatttctttataattcccaacataaaattaggttgttttgtaggaaaatgcatttagcacaataaagatctcatggttaaagactaacggactttctatattccagacttcactgtgaaaaaaaaaaaagccaagtatgcagagacaaaatgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatggagagagctcttatgacccaaacttcagcctcctgagaattctgtcaacaggcctgatggcagggagggtacctcatcctagtatgactctaaatgcactttcagaaaaactttttggggaaaaacagttacttagagtttaagagaattcatcgttttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaaggtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgactttctacctcacttaggccatccccacatcttgcaagtgatgctggaaaacagctgttctgtaatatccttagagtcagaactgaactaagattctgactttccccaagggcaatcttctccacccttctcagtcagttgaacaagggaaaaacctctagatggaagggaagagcccctacaatcagaaacccattttctaaaaactaacattccacatgtcatcatcatttgtaggggcaatttaaaaaataatccttggaagtcttgtctctaaatcatctccattctcactgtaaattattcttacccttgtcataccacacctacatgaggcatcacaacagccacctaacttggttctgctgcatcctctccttgctactcaatgcagaggaccagaagctggttagacatgcagagtctcaggccccaccccagacttattcagtcaaaaactgcacttgaaaaagaccctcagtgattcatgagcacattaaattggagaagaactattcccagccatccacactatcagccaaaccactcccttttttagtaaatcagtactgctcagcctggctaagaaggcccaaaagagacacttcgaagtcctgagcattactttccaatcctgctactatgcactctccatggaaagcagactgccttctggagaacacaggtagaacacctggcacagtgctaagtggcatctagtatccactcaataaatgtgcatttcctttccttatgtctattcaccacttactatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttgtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatatgtttcaggagggcaaggagcaagtcttaacctcgttggaattttccatgacttccctccacccaataatgccccttcatacctaccccagcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgccagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttattaccaccaaataaacaagatctcctctagggaagcccagatgttaacaacttaaaggctggttttttgtaaacatttacattaacaaccattacctattaagagtgaaatatctgctccatttaataaaaatagcaatattgaactgctttacattataaacattgttattttaacgacatgttcctgaactggctaagtccgtaacaaaaacaatgaacacgctgaaatgagaagagtattttgacttgagaaatattaaaggtgttacaagttcgacaaatgaaattaacaaacatgtttgtaattttctttttttcctacaagtgtattttataagacatactggtgtgaaaattatttgatctctgacaaagctaaaattaaaatattctccaatcaatgagatgaaaatactatgacttccagtgtaatttatctacttagtatgtgtataaaatgaagcttatttaaaaatatcatgttacttatcactgtatattggctcacccttaaaaaagggaatcaaactatttcctagtactttttagaacatgtatatgtttacaagataggcattacattctctatacagctagcatagcaccaaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacaggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaagacaagtaatgtgtcccaaaaaacttggttttgcatgatattggtatgttagccagaaaaatggtgatgagactcaaataagcttgagaagcatttagtaggcttttcctgagcctttaatatgcccagtgtcttgtgaatctgcaaggaggaatttcttcaccatgaaacacctttttcacagtatgaataaacacctcattggaagagtattccctagagtgccagattagaaaatatttttatatacacataaatgttatatatagctagaatcccaaaccatttccataaaggaatcattttgttcccatactatgaacagattcctgagggggatggtagaagggaagaactatggtaggagggacactgagaaagggaaaaaatgattccttccccagaagcaagcccaatagtgacctattttcccaagtaggggaaaggatatagtactcatggcttgaatgccctgactgaacaaggaaaccctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattccttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcctttgctttttccccaggtctgcttcaaagtatccttttaggagctcaagaccagcctgaccaacatagtgaaaccccgtctctactaaaaatacaaaaattagccaggtgtggtggcacgtgcacgtaatcccagctactcaggaggctgaggcaggagaatcgcttgtacctgggaggcagaggttgcagtgagctgaaatcgtgccactgcgctccagcctgggcgacagagctagactccgtctcaaaaaataaaataaataaaaataaaataaaatacagccgaagaatgtaaatttcagcagaatggcaaatgtgggttaaagacttaatgttttcttaggttacttactgcaagaactgccctgtcccgttccaccaagtctgcaagcttatccaacagacgtcccctttctgaagcatccatccttctccacactgaaccaagagagaaagccaggcgggctgcctgcactgctttgtctatatctgcctgttagagaggaagaggcacaactgaagaaaaacactccaaataaaggaagaaccatccactgtcatgaaaaaagtgaagcatgagcatgtagtggtgtactgagagcatatgtttgctgctctgctgtttgaaggcagttatttcataggaaatcttttatctacaaaagacataccttgtctgcttcttgaacttcacacacctgttctcctgtggctggattatagacagggaacactctcccactctctgagttctgccactcgttgtttataaagatctaagggagtagataacagaatgggatctgtgacacaggtgataagcagccagtcaacggccaagtgttacggaactactatggtaataacacttgttgtataataaaagtatacaatttgaagtgttttaagagacccttctagactcaacgccaatttaggaatttcctctatatttttgctttaacatcatccaaaggctaactacagttcttacctttcatgaacctgtcaactaactaaagatacaaataaggatagagtgtctcacatacatacaatcatacactgatgctaaggcaagagttatcgatagcccaagctctggctagtatccatgagggttaaatagcagatcaaacttacagtcatcaagccttagatcctactttctctgccacaggcctaagtgacttctcaaggaaacttgaatggtgctgcaataagcattcacctaatttatactcaggtcctgaacaatgactctaaccaaactaactagttagttcaacaagttatatgtgtaaatccaagttagatttatttccctttgctgaataggctatcttgcagagccaaaaaagatggggatggggagttagcaagtggggtgtaattttcaaatgatcaccccaggatttcttaaaaggcttggtctccctatgtatgaaattgagattaaaatggcaaagagactgaagatttgggaaattattcaagtcaatttctcacaagatttgtaataaatgagttaaaggacaagggaaaagaaaaggccagaaaaattttaaattcttattgagtgagaaacctaaactaatatttttagaccatgtaatcttagaggacatacgaagatgttttactctataaaatttacagcaccacagtgaaatttctgaacttatgaaccagtcagtcatctaatttaggacaaaaacaatgataattatttagtgcctgccatttaaaaaataatcagagatgaggcttaataaatataaatctacacttggtaaatatcaaattctagaaaatgtcccaaagctttccttttacatgttttccttgatttgataaaaactatgagcccatgtagaaggaggcactgattaaactataactttcttttcccaaaggatttttaagataaaggaaaataccttaaatttgtagagcacttaacacagctgtattgatacaaacaaaatgaccttgtaattgtacattttacagtttataatacacagttcataaacacatgtaacaaaatttacccaataaatactcagataacttctagtcacaggaaaaataaagatggttaagagagttccagccctccagagtctgacagtctctagtagtttatttagtacttacaataaccccgtgaagcagggttttctctctattacacatgagaaaattgagaggcagggagcttgagtccaaagaagcaggttcttgttgtggctgactcaacaatgtgttctttccaatacacataatttccaggattagtcagcccaaagaaacagaactagttaatgtccaagcctgagctagttagaattcttaaattattggtctggttctcttttcattcactctatttaataaatttgctcacagctgatagctcattacattttcatgctcctttgaacacagtataaagtccaggtaacaaaaggagaaaattaaaaagttagtttcattaaggatccacttcttgggtattatcaggtttagggaaaaagtggtcttacccatgtccctatccttttattcaccatgtgactgaatcaaactttttaacctttgcagtatcaccaaggcccactgatcctaatttttttttttttttttttttaagacagagccttgatctgtcacccaggctagagtgcagtggcactcaatctcagctcaatgcaacctctgccgcccggggttcaagtgattctgctgcctcagcctcccgagtagcagggattacaggcacccaccaccatgcccagctaatttttgtatttttagtagagacggggtttcaccttgttggccaggctggtcatgaacccctgacctcaggtgatctgcctgcctcccaaagtgctgggattacaggcgtgagccactgcacccggccccaagttcagtttttaggtttctctgtgcagcagttttaattatttgtaaagactgatatttcatgacttttgtttcttacaggttttccaaaaatcaaaaggaaaaaatacttatttttagtaagttaaactcattttcttcatcacttagtctattgatcattttataaatctaagatgcattataggatctaagatacattatgatattttagtgatcttatatttcctgtattttaaagtattttgctacttcatcatgctagaaattacttcatcatcactcatcaattatttctaattgtgctaaaaaactaaaataaggaaaaaaaaattacgaaattgcctagaaatgaatgtcaccactgtatcatccttccgttttctaattgtgttgtgtaatacatctttcaaaaagttataaaagaagtctagagatgccatctttgccatattcttttcagcttccattaaacaaagttaagaatttggaattcttaattttctgcccataatgggataaagaataaaattaagagaaagatatttcacaataattagatgaatgagaaaatgaaggcagagacagagcacttgagattctaatgatgaggtaaaactgaccatagaagcaaaatcttgggctatgagtccttcagataaattctgtcagacttgagaatcagagtaaacaatatatttacaaagacaaaaaggaaacatgatattctaacccattaattatttaataggaaggacttcatcatttagtattttgcacaagaacctggaccatcctgctctgataaaaggacatatgacaattattttatcttttatagtatttgttgataaaatttacttgatattcataaatggacaaatgctgaaggtaggtatatatgtaaaggtgactggaacagacagacattatgtagaaattttaaaagttcattgggttgctcaatctgattgacatttataaaagtaaaaatgaaaatatttttgtaattgtgaaacaaaaacatggccaccttcttttctacaaaatcatgaaccctcaaatttctccatagcattacactgtgataataatgcatatgcaggaagaaccagagataatgatgagctataacctactagagatctgtttaaaatctggagccagtatttacgagatgataatgttctaggttcatatacgacagctcatgaccagttatttgcattcaaaggcattgccaatttcaggttacattacctccaaaatcaggaaaatatgaaataaaaacgtggtttgctatgtttaaattcttattttgctgttttttttaccatctctttattcttacttctgtaaattattcataaaaataaaaataaaaataaaatgaatacattgaaaccagatggtaaatgtgatggctatttttcctggtgtgccaaaattaaaattttaattttactacattattatttttgtagacctagtcttataaaatgacacttaaaaaattatatggacaactttgttggtacatggaataacaaatatcttcatggtcagtacttgaatgtttgcagctctctaggcaatgtcgaaagttttgaatcctgtccatagcattattccctgaccagggctccttggagaaatggtttatttcagaactgtatcagggaaagtacaagatgagcctggaacattgtggtgcctgaaatcaagtaaatacttaaaaatggataggaagataataaaaagatacagaagtcaccatgaagaggctaccaatggacaatactggaataatttaaacaaaaaataaataatgctggtaatagattatgacccatagaatgaaaaagacatccaaaagttcataatgatatacatttttaaatgaataaataaataaatgtgggataaggaggcgctcttcttcacagtagaattccaactactagatgtgaagagatgatgggattagatgattattatttgtaaaataccatagtaataactgcttcaggtaaaaatcatcactagatagtaaaattggtgggcaaatatgcaatgaaaaatgtatgatgtatattcatgtagtttcaaaatatctcccctcaagatacttaattacaaaagaaaaaatagtaactttatgttggagaaacttggcagacaccaccttaatcaaatgattaaagctgatgtcaccagcaatgggacaaattgatatcatgtgcagctgatatgatatgctgagaaagacaagatcagttctgtggtaatcttacccaaaaggcataacctaaattcaaacatgaggatacaacaggcaaatccaaactaaagcatattccacaaaataattgtcctatacttacttaaagtgccaaggtcatgagaggctagtaaaatgaaaacaactgttccaaattaaaggtcactaataagacataaaaattaaatgcatcatgtaaccatggattctctgatgggccaggaaaaaaaatacatattattgggacaattggtgaaatttgaataagatttttaggttagatgataatattttgtcaatgttaatttcctgatttttataacttttataattgtaagatcatttggggaatctgcatgaagtgtacacagaaatttttgcactatttttgaactttatttttgtaaatctgaaattatttcaaaatggaaagcaaaaaaaaaagtttaaaagtcagtgtcatctttcagtgcctacctttcatattttaaatgccccaaacaaatttgttaaacgaagaaacgaggattcaacatcttcacaagagtttctttaaatgtgactttgtggaaaataaaataagccactcaagctctgtcttgaaacatggcccaatgatgccaaatcattttaagttaaagccatgttaatctcagtataagaaaccagaatattttgctttgtagtttactgaatttcagaattagtatgaggaaaaatgtgggctttactacagaggtctttgaaagtagaaagtgtatctgaccctaagttactggactgttgctcagtttcttcatttggaaaatatagaaatgctgacttactaaaatcatgtaattctgtgatgctgtaaccgaaggtaaaaagaacagatggtccataaaagaaggcacctatctaatctaggtttctcagaggttggagggattagttcatatccctttctttccattgtggttgtgaaggactaactgtccactgacatattataggttgttgttggttttaaaaagacagaatgataggcacttagctaacattaaccaaaatggaatgtctgctgagagaggaaatgaatcactttcttttttattattattttttaaatgttatttaagttctgggatacatgtgcaggacatgcaggtttgttatgcatgtaaacatgtgccacggtggtttgctgcacctatcatcacatcacctaggtttaagccccccatgcattagcttttttatcctgatgctctccctccgcccaccccctccaacaggccccagcatgtgttattcccttccttgaatccaagtgttctcattgtgcaactcccacttataagtgagaacatgtggtgtttggttttctgttcctgtgttagtttgctgaggataatggcttccagctccatccaagtacctgtaaaggatatgatctcattcctttgtatggctgcatagtattccacggtgtatatgtaccacattttctttatccattgatgggtatttgggttgattccacacctttgctattgtgaatagtgctgcaatgaacatacgtgtgcatgtatctttataatatgatttatattcctttgggtgtatacccagtaatgggattgctaggtcaaatggtattgacatgaatcactttctaacatctttcctgatatggtcagaaatacagtacctcccacaccaagaacaaatctgaaacacactgaagaacgaggagaatatgtgaggaacaaaattttcttatatttaatagatgtggtaaaaacatatgtaatataaatgcaagctaagatctaccatattaaaatataccatgaacacatcattcaagcactggaacattattagtattactgaagctacctgtgtgtttcttcctaatcccgtcctccagcttgacccaccctgccactagaggtaaccactaacctgtatttttaatttatttattcttagatattttctttcattttcttgatcaaatgtagtatttatttgatgcaggtttctgtgtttattgtatcaattttgtaaaatgcattaggatcatcttgattgtcattaacgttttatgtttgtactatgatcactgagaaagccatgctgaaatttcccatggtggtggatttatcaacatattccttaactctaaatttctacctttataattttcggggtattttattagtgaatataagttcataaccattagatctctctggtaaaccatttatcaatatgaagtgatgctctttattactaataaagcttccaattttagagcctattttgtttaatagtagcatagctacccaagcctttctccagtatttgtctcatttatcttttcctgtctttctgctctcaactatatctttattattttgatgtgtctctgtaagtgacatatggttagattttatttaatatgaaaatctgcattttaactagcaagtttaatatatttctattaactttttgagttggggagggttcactagaagcagtttatatgactgactcctccacttagaaaaaccagaacagtatatagacagtcacacttcaaatatattatccaagagaacaccggaattcaacaaagaagggacaggaagcaccaaaagtaagaaaagaggttgcctcttgcatcctccctgactgggatcagctgggagccaggagtgatttcccaaagtgggaaatgggtgagtgggagacttccagcagccaacatccccaccgtggaattgtgcaattctggccacttgaaaagccctcaatcctcccaagccccgaaactaacacagggagctgccaagagaccatgaaatggaactgctcctaggagagaacttaacactgggccccacatcctttctgagacctaagcagctacagcaaggcatcatttccaaacctagcctttgacaaacgtcgtgctgtcctggggcccagcagttccaggactgaggcattaaggaaactcaggctattactgctgggacagcagggcaagctgggagtgctcctgtagccaaggctaagaagccagtgagacatgagctgaagcacccagtgctggtagacatgtgttgctgagatctaagatggagacacaagttgctgctggaattggtggtgagctgggcaggggttgctgcagctggtgcaggcggatgagttaggtgcaggctaccgccaccagggtaggggatcaagcctcactaaaactggggcatgaaagaggcacaattccccacctgccggtccaggctgtggccactgatgatggccaaatcctctccagtggcagggcctcaatgcagctgctactgcccctcactcaagcactctgcctagggcctaagaattgccctgcccctgcccatcacagctagtgcctcctctcaccactgtgggggctgaacaaaagcccatctggcctcactttgttccccattcccgagacagagcacatagattgaggtcctggagattgcccaacccaatctaccaccttgggtacctgaacattccgtacagggtactgaggttgggcctaacttcccagccactaccacataagctgaaatctacctgcaagtgcaacctcgggcctggagacttgcctgtccagcacatcacagccactcccaatatccatgcacactactcaggatgcagaggatcatcctactactgctactgccattgccatgccatacaagctgcctagggacctgagaacacatccaaccacctggtccactgctgccactacctccggggggaaagccacctcaaggccaagaatcagcctgctccaacacaggtgccagggtattccacactgaggcacaaagacaggcacactcaacccaccactgcaaccactagggcctaaagactggcctacctggcatcccagtcctcagcacaacttcaccacagcctctgctaataaccacactataacttaccaaggaaatcacagatatcactgatgttgtttactgccaaagaaatcatatagagactacaccactgcatccacccagaatcaaagccaaaatgccccatccaaccaacaccatatatacaccttcaggaaaaattcctcccctatgaaagtaaattcaaaaataggaagaaccaactgttataccagatgtgcagatatcaacataaggacaacatgaaaaagcgaagaaatatgacacctccaaaggaacaccatactccatcaacagatcttaatcagaaaatttcaaaatcccagataaagaattcaaaatattgactttcaagaatcttagtgagatacaagtgaattctgaacataaaaaatcagaaaaataattcaggaaataaatgagaaacttaccaaagagataaatttttttttaaagaaacaaatagaaatctggaacagaataattcattgaagggaaaaaaatgcatttaaaatcttagaaccaggcaaaataatttctaatcttcaagacaggtcttttgaaataatccagtaaaacaaaacaaagaacagagaatttaaagaatataagcaaagcctttgtgacacttgggacaattttaaagtgaccaaatttacaaattattagtataatcaagaaacaagaaacaaagatgaaaacttgccaagcctagcaatatttaacacatgcagatacaggatgcttaatgattctcaggcagatacaatatgaaaaggttttctacatagcatattgttatcagactgtctgaagtcaatgataaagagaaaatcctaacaacagcaacagaaaagcatctagtcacctataaaggaaaccccatcaaactaacagcagatttctcagcagaaaccttacaggccagaagagaatgagatggtatattcaaagtgctgggaaaaaaaaaaaaggaactgccaacccagaatattatctctagcaaaattatccttcacaaatgagggcgaaatagactgattcccagataagcaaagactgaaggaattcattaccactaggactgaccctacaagaaatgctcaaaatagggctgggcagggtggtgcatgcttgtaatcccagcattttgggaggccgaggtgggtggagcacctgaggttgggagctcaagaccagcctgaccaaatcatggagaaacctcctctccactgaaaatacaaaattagccaggcgtggtggcacatgcctgtaatctcagctactgggaaggctgaggcaggagaatcgcttgaacctgggaggtggaggttgcagtgagctgagattgcaccattgcactccagcctgggcaacaaaagcaaaattccatctcaaaaaaaatgctcaaaatattaactctgaaatatggaagtataaaactcatttgtaaagtaatcacacaaaggaggaagagaaaagactcaaatggtaccactacaggaatccaaactacagtgtaaacaataagaaaaaaaaagaggcaaagaatatataaaacaaccagaaaagagatataatggctgaatggatttttaaaaaatgatccaattttatactgcctagaagaaactcactttaccagtaaagacaaatgtagactgaaagttaagagatgaaaaaaagtgaaaaaagatattccactcacatggaaaccaaatgtgagcaggagtagctgtatttatatcagataaaaacagattttaagccaagaagttcattatataatatgagggaatcaattcaacaagagaatataaaatctaaatatatatgtatcaaacactggagcacccagattcatagagcaaatattactagatctaaatagacagactacaatacaatagtgggggacttcaacaccctcactgtcagcactagacagatcatctaggcagaaaatcaaccaaaaagcactggatttaaactagactttacaccaaatagacctaacattctatccaactactgcagactatacatccttttcatcagcacatgcaatattctccagaacagaccatatgttggaccacaaaataaatctcagcaatttttaaaaaatcatatcaagtatctcctcagacaacaaaggaataaaactagaaatcaatgccaagaacaactctggaaacgatacaaatacatggaaattaaacaacatgctcctgaatgaccactgtgtcaacaaataaaaatagaaatttaaaaacttcttgaaacaaatgaaaagagaaacaacataccaaaactcttgggaataacaaaagcagtgctaagaggaaattttatagcaattaatgcctacatctaaaaaaagtagaaagattataaattaataatctttatcaatgtaccttgagaaactagaaaaacgcgaagaaaccaaaccccaaattagcagaagaaaataaataataaagatcagatgtaactaaatgaaacagagactaaaaagaatacaacaggatcaacaaaacaaaaagctggttctttgaagagataaacaaaatcgataaactgctacctagactaacctaaaaaggagaagaatcaaacaaaatcagaattgaaaattgaaaacagagacattacaatggataccacagtaatctctgaagaactacacattgacaaactgaaaaacctaggggagatggatacattcctggaaacatataagctaccaagattgaatcaggaagaaacagaaaacctgaacagctcaataacaagcagcaatattgaatcagtaataacaaggttctcaataaagaaaagcccaagacaagaatccagccaaattctaccaaacatacaaagaataactaacatcaatcctcctgaaactattcaaaaaaatcaaacaggaggaatgtgttagtctgttttgtattgccgtaaaggaatacctgaggatagataatttaaaaagaatttatcttggcttatgattctgcaggccatatgagaagtagggtgccagcatctgctcttagtgaggccacaggaagcttacaatcacggcagaatgtgaaggggaagcaggtgtgttacatggtgacagagagagcaagagagaaaagaggaaatgccagacttctttaaacaactagctctcatgtgaactcacagagcaagaactcactcattacctcagagagtgcaccaagccactactgacagatccagtcccatgaaacaaacacctcccaccaggctccacctccaacattggggatcacattgccacatgagatttggaggggacatacatccaaaccatatcaagggaattctctctaaatcattctataaggctagcatcaccctaataccaaaatcagacaaggatacaacaacaaaataagaaaactacaagccaatatccctgatgaaatagacacaaaaatcttcaacaaaatactaacaaacctaaatcaacagcacattgaaaagataacacactatgataaagtaggatttttaccaggaatgcaaggatggttcaacatacacaaatcagcaaacatgatacactgaaaatctacagaatgaaggaccaaaaccatataatcatctcaatagatgcagaaaaagcatttgataaaatcaacatcccactcctatcggtatgcttccaagatggccaaatagtaagagctctggtctgcagctcccagcaaggtgaacacagaagacaggtgatttctgcatttccaactaaggtacccggttcatttcactgggactggttcgacagtgggtgcagcccacagagggtgagccaacgcagggtgggacatcacctcacccaggaagcacaaggggtcaggggatttccctttcctagccaagggaagccatgacagattgtacgtggaggaacagtacactcttgcccaaatactgtgctattcccacagtcttagcaagcagcagaccaacgtattccctcccatgccaggttcggcgggtcccatgcccacggagccttgctcactgctagtgcagcagtctgagattgacctccaaggctgcagcctggtcggaggaggggtgtctgccattgctgaggcttgagtagcaggtaaacaaagtggccagaagattgaactgggtggagcccactacagctcagcaagccctactgcctctctagactccacctctgtgggcagggcatagctgaacaaaaggcagcagacaacttctgcagacttaaacgtccctgaagacagggacagctctgaagacagcagtggttttcccagcacggtgtttgagctatgagaatggacaaactgcctcctcaagtgggtccctgacacccactgtaggctgactgggagaccctcccagtaggggcctaaagacacctcatacaggcaggtgcccctctgagatgaagcttccagaggaaggattaggcagcaatatttgctgttctgcattatttgctcttctgcagtctctgctggtgatacccaggcaaacagtggacctacagcaaactccaacagacctgcagctgaggggcctgactgttagaaggaaaactaacaaacagaaaggaatagcatcaacatcaacaaaaacgacatccacaccaaaaccccatttgtaggtcaccaatatcaaagaccaaaggtagataaaaccacaaagatggggagaagagaaacctgagcagaaaaggtgaaaattctaaaaaccagagcacctcttcttctccaaaggatcacagctcctcaccagcaatggaacaaaactgcactgtgaatgagtttgatgagttgacagaagtaggcttcagaaggtcggtaataacaaacttctctgagctaaaggagcatgttctaacccatcacaagaaatctaaaaaccttgaaaaaggttagatgaatggctaactagaataaacagtgtagagaagaccttaaatgacctgatggagctgaaaaccatggcaccagaacttcgtaatgcacatacaagcttcaatagctgattcaatcaagtagaagaaaggctatcagtgattgaagatcaaattaatgaaataaagcgagaaaataagattagagaaaaaagagtgaaaagaaagaaacaaagcctccaagaaatatgggactatgtgaaaagaccaactctatgtttgattggtgtacctgaaagtgacggggacaatggaaccaagttagaaaacactcttcaggacattatccaggagaacttccccaacctagcaaggcaggccagcattcaaatttaggaaatacagagaccaccacaaagatattcctcaagaagagcaaccccaagacacataaatcgccagattcaccaaggttgaaatgaaggaaaaaatgttaagggcagccagagagaaaggtaaggttacccacaaatggaagcccatcagactaacagcagatcccttggcagaagctctaaaagccagaagagagtgggggccaatattcaacattcttaaagaaaagaattttcaacccagaatttcccatccagccaaactaagcttcataagtgaaggagaaataaaatccttcacaaacaagcaaatgctgagagattttgtcaccaccagtcctgccttacaagagctcctgaaagaagcactaaacatggaaaggaacaactggtaccagccactgcaaaaaacatgcaaaattgtaaagaccatccatgctatgaagaaactgcatcaattaacgggcaaaataaccaactaacatcataatgacaggatcaaattcacacataacaatattaaccttaaatgtaaatgggctaaatgccctaattaaaagacacagactgctaaattggatagagtcaagacccataagtatgctgtattcaagatactgatctcaactgcagagacacacacaggctcaaaataaagggatggaggaatatctaccaagcaaatggaaagcaaaaacaaaagcaggggttgcaatcccagtctgatgaaacagactttaaaccaacaaagatcaaaagagacaaaaaaggccattacataatggtatagggatcaattcaacaagaagagctaactatcctaaacacatatgcacccaatacaggagcacccagactcatgaagcaagtccttagagacctacaaagagacttagactcccacacaataataatgggagactttaacaccccactgtcaatattagatacatctacaagaaagaaggttaacaaggatatccaggacttgaactcagcactgaaccaagtggaccaagtctattaagactctctaccccaaatcaacacaatatacattcttctcagcaccacatcgcacttactctaaaactgaccacataatttgaagtaaaacactcctcagcaaatgtaaaagaacagaaatcacaacaaactgtctctcagaccacagtgcaatcaaattagaactcagggtaagaaactcactcaaaaccgcataactacatggaaactgaacaacctgctcctgaatgactactgggtaaataacgaaatgaaggcagaaataaagatgttctttgaaaccaatgagaacaaagacacaacgtaccagaatctctgggacacatttaaagcagtgtgtagagggaaatttatagcagtaaatgcccacaagagaaagcaggaaagatctaaactcaaccccctaacatcacaattaaaagaactagagaagcaacagcaaacaaattcaaaagctagcagaaggcaagaaataactaagatgagagcagaactgaaggagatagagacataaaaatcccctaaaaaaaaaaaaaaatcgatgaatccaggagctggttttttgaaaagatcaacaaaacagatatactgctagcaagactaataaaaaagagagaaaaatcaaataaaaatgataaagggaatatcaccaccgattccacagaaatacaaactaccatcagagaatactataaacacctctatgcaaataaactagaaaatctagaagaaatggataaattcctggacacatacaccctcccaagaataaaccaggaagaagctgaatctctgaatagaccaataatcagttctgaaattgaggcaataatagcctaccaaccaaaaagtccaggaccagatggaatcacagtgcaattctaacagaggtacaaacagcaaagacgatctggtaccattccttctgaaactattccaatcaatagaaaaagagggaatcctccctaactcattttatgaggccagcatcatcctgataccaaagtctggcagagacacaacaaaaaaagacaattttagaccaatatccctgatggacactgctatgaaaatcctcaataaaatactggcaaaccaaatccagcagcacatcaaaaagcttatccaacacaatcaagttggcttcatccctgggatgcaaggctggttcaacatatgcaaactgataaatataatccatcgcataaacagaaccaaggacaaaaaccacatgattatctcaatagatgcagaaaaggccttcaacaaaattcaacagctcttcatgttaaaaactctcaataaactaggtattgatagaatgtatctcaaaataataagagctatttatgacaaactcacagccaatatcatactgaatgggcaaaaactagaagcattccctttgaaaactggcacaagacaaggatgccctccctcaccactcctcttcagcatagtattggaagttctggtcagggcaatcagagaagagaaagaaataaagggtatctaattaggaaaagaggaagtcaaattgtcccggtttgcaggtgacatgattgtatatttcgaaaaccccattgtgtcagcccaaaatctccttaataggcaacttcagcatagtctcaggatacaaaatcaatgtgcaaaaatcacaaacattcctatacaccaataacggacagagagccaaatcattagtgaacttccattcataattgctagaaaaaaaataaaatacctaggaatccaatttacaagggatgtgaaggacctcttcaaggagaactacaaaccactgctcaacaaaataaaagaggagacaaacagacggaagaacattccatgctcatggataggaagaatcaatattgtaaaaatggccatactgcccaaggtaatttatagattcaatgccatccccatcaagctaccaatgactttcttcaaagaactggaaaaaactaaagttcacatagaaccaaaaaagagcccgcaaagccactacgatcctaagcaaaaagaacaaagctagaggcatcatgctacctgacttcaaggctacagtaaccaaaacagcctggtactagtaccagcacagatacacagaccaatggaacacaacagaggcctcagaaataacaccacacatctacaaccatctgatctttgacaaacctgacaaaaacaagaaatggtgaaaggattccctatttaataaacagtgctgggaaaactggctagtcacatgcagaaagctgacactggatcccttccttacaccttgtacaaaaattaactcaagatggattaaagacttaaatgttagacctaaaaccgtcaaaaccctagaagaaaacctaggcaataccattcaggacataggcatgggaaaagacttcatgactaaaacaccaaagcaatggcaacaaaagccaacatagacaaatgggatttaattagactaaagagcttctgcacagcaaaagaaactatcatcagagtgaacaggcaacctacagaatgggagaaaattttttcaatctacccatctgacacagggctaatatccagaatctacaaagaacttaaatttacaagaaaaaaacaaccccaacaaaaagtgggcaaagaatgaacagacacttctcaaaagaagacatttatgcagccaacagacacctgaaaaaatgctcatcaccaccggtcatcagagaaatccaaatcaaaaccacaatgagataccatctcacaccagttagaatggcgatgattaaaaagtcaggaaacaacaggtgctggagaggatgtggagaaataggaacacttttacactgttggtgggactgtaaactagttcaaccattgtggaagtcagcgtggcgattcctcagggatctagaactagaaataccatttgacccagccaccccattactgggtatatacccaaaggattataaaacatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacgaaaaaccaaacaccacatgttctcactcataggtgggaattgaacaatgagaacacatggacacaggaaggggaacatcacacaccggggcctggtgtggggtgggggaagggggtagggatagcattaggagatatacctaatgttaaatgagtagttaatgggtgcagcacaccaacatggcacatgtatacatatgtaacaaacctgcacgttgtgcacatgtaccctaaaacttaaagtataattttaaaaaagacaaaaataacaaatgccagcaaggatgtggagaaaaggaaagtcttgtatatggctggtgggaatgtaaactaatacaaccactatggaaaacagtgtatgtggatttctcaaaaaactgaaaatagaactaccatttgatcaagcaatcccactattggttatctatccaaagcaaaagaaatcaatatatcaaagggatacctgcactagcatatttattgtagcactattcacaatagcaaagatacagaatcaaccaaagtgcccctcaacacacacacacacacacacacacacgtgcgtacccaacggaatattatttagccatagaaaagaaatgaatcatgtcatttgcagcaacgtagatgggactggaagtcattacaagtaaaataagccaggcataagaagacaaatattgcatgttctcatatgtgggatctaaaaaatatgaacacatagcggtaatgtaaaatagatcagagacactgggacaggtgagtgggggtgaagggagaggatgaagagaggtaggttaaaggatacctatagtaagatagaaggaataaattcattgtttgatagtagcttcggatgactatacttaacaaaaatgtactgtacttaagtgatggacacctttaatatccagacttgattaccacattatattcatgtaacacaacatctcatttacccccataaatatgtgcaaataaaaaatgcatttgtatgtattgggattatatttagtgttatatattctgttatatcaggacttgatgctttctatttgacatgctttattttaccttctattttctcctttcttgcctcttagttctagttgattaaagtatgttgttattgttgctcattttataatgcagttactgccttctattggtttggaagttgcacactgtatttttttgtttattcatggtattttatcatgcatatttaacaacttcacctttaaaattaatcaatatcttaaacctcccccaaaacaatacaatgaccttacaacactaaatctaatcactcttctccagaagtttgtcataaattattttataccaaaaaaatgatttctcaattaactcaatattaaattgtgagttaatttttgtggaagttgtaagttcagtgttaggactctttttttttttttttttacatgtgaatatctagtttttccagcatgatttgttgaaaagacaatcctttctccactatgtgcttttgctcctttatcagggatcagttgactacatttgtgtgaatgtatttcttggttctcttctctatttcacttatttttctgtattttttttttgccagtaccatactatcttaattactgtagctttacagtaactcttcaaattggatagtatcagtcctcctcttttgttcttttccttcaatattgtgttggctattctaggtcttttgcctttccatataaactttataattagtttgttaatatctacaaaataacttactaggattttgattgggattgcattgaatctacatattaacttgggaagaaatgacatcttaataattgaggcttcctatcgatagtgtatctctccatttatttacatctcctttgatttctttcatcgaagttttgtggtttcccttataaatgtacatattttattatatttattcctaagcatttcagtggtaatgtaaatgataccgtgtttttaatttcaaattccaaatgttcatcaccagtatataagaaatcaaatgacttttgtagattaacatagaatcctgcaaatttatagtaatcccgtcagttctagatgtttttttcttttttggagggggattgattcttaaggattttctacatagaaaattatgttatctgtgaaaaaagacatttttccttcccagtctgtatacattttcttttcttactgcattaactagaacttctagtataatcttgaatagcagcagcaagagggggtagcctgtcttgatcccagtcatagtgggaaagcatctagtttctcaccattaaatattatgttagctataggttttatgtagatgtttttcatcaggttgaggagattctcctctattcataatttttgagagtcttccttctttatatgatgaatgggtgctgaattttgtcaaatactctttctgcatgtacagacatgatctcctgattttttctttgtcagcccattgataagacagactacattaattgaattttgaatgccaaatcagccttgtatgcctgaaataaatcctgcttggttatggtgtataattctttttatacattggtggactcaatttgctaatattttgttgtggatttttgcatctatgttcatgagaggtaatagtttgtagtattccattctcgtaatctctttatctggttttgatattagggtaacgatggcctcataaaatgagttagtgctccctctgcttcaactttctggaagagactgtagataattggtatgtttgtttggtagaagtcaccagtgaaaccatctggacttagtgctttcttttttgaaaggttattaattattgattcaatttcttgaacagatacaggcctattcatacatatttctctttgagttttggtagaatgcatctttcaatgaattggcccatttcacctaaattatcaaatttgtgggcaaagagttgtgtataatatttctgtattattcttctactgtccgtggcagtagtagcaatagtccctctttcatttctgatattagtaatttgtgtcttctctttttcttttagttagccaggctacatgtttagcaattttattaatttttttcaaagaaccagtctacagttttattgtctttattgttttcattttcaatttaatcgatctgtgctataatttttgttatttttttgtttctgtttacattactcttctttttctagtttcctaaaaaagcttagactatttcttatttttaaatatatgcattcagtgtgatacatttctatctaaatactgctttagcagcatcccacaaattttttaagttgtattttcatttagttcaaaatatttcttaatttctcttgagacttactctttaactcatgtgttattcagaagtgtgttctttaatttccaaatatttttggtttttccagctatctttctgttttagtttaattccactgtaatctgagaatatcttttttgcataatttctacttttttaaacttgttaaagtgtgatttataccccagaatgtggtctatcttgctgaatgctttgtgagagcttgagaaaaatgtgcattttgctgatgctggacatagatttattttactagtcccagaactggtattggcattcacctctagagtaaacccagcttttgcattttcctttagctccctatcaatttccagatcactgttcttttaattaatcaatacattaaaaaataatgtatgcaaggatagctcttactacttctatttaatagtgtaataacatttgctattataatatgaaataaataggaggccaaagttttaaaataaaagaagtaatagtatatttttagatgacattattgtctatgtagaaattccttaaaaaatctacaaaaattgctagaagtacaaatttagcacaaagtcccaggatacaagatcaatatataatcaatacactatcaacaaatcactggaaaataaaatttaattatgcacacacatatacacacaaacacatattcatgttcatacacatatttatccaagatctagatgcataatgacagaaagacactgggcagcaacttttggcagcaactattaaccttttaaaatacataaatttaaaaaataatagtctaaagaaatgtctaaagaagagttatggctcttagttgaaatgcaaccactttttaacattaagggacctgcgcaactccctcccacatcctcccgtcaaacaggttgatataacatgaacagcaccagttggaactaagaaggaaaagaatacctgagcagaaatttgacttcacagaagacactgcaaaatatatactaaaggcctcttctgagcatgaaattgtaagtacgactgaaaatccacagaagacgtgtactctggagcttataataatgcttcaatgacaagattactctaaggaaagttaaataacgtaagacactgtgatttagtgccaagatggatagtatagataagcagtgaaggagtttgcttcagagaaaagagaaatctgtgtggctgacatgttagaataacactttggggaaataagaaataattaggaagtatgacctggagtagggaatggggaagtacaagaaagaaactctatcctcagtagaattattcagccggcctgatcagcccttctttaactttagctcctctcagaagattatctgataccccgatttaagaagtgtaacaaagaagaaagaaatggacatttagcttttctccccttctaccaaaagctcaaatgatgaaggtgccccttggattcttaacaacagcctctaccacagcactgtcctcaaagtaagtagaatatgtatttaagcagcaaggcccccaaatcacaaagaatgagagtaaataaatcagaaaactcatataggtagtagacagagtcatagaaagaagacctcagaaaagagaaaaaaagaattatgagaaaagagaaagaatttttaaggtatgttataaattaaccacacatttaggaaggacagttaaaaaatggagtgaaaaatactgtagaggaaacaggaagaagagacttttaaaagccaaggaaaataaatactgacagggctaagagaaagaagtggaactcatctcccatgaaacttcaaaatttaggcattcaatacttaaactattcaatgttgaataactagctttattttttttcatcatgaaagtattgttagaaaaaccattaaagcaagaccagcctgaaaacatggacagcccatgacatgaagaaataaatgtgatattcacattcttgtgcatcataattctatttgcagacctagattatgcttttggttttggtcaatttctgcatttagctagtatcccacataattcagaagaaattgtactgtctggaagtgtgcaattccttgggtagcatcatccctatatgtgtacttaagccaaaaggttctaagaagccatgcaaattaaagcagaaataaagataagaggtccctggcaaccagcagtctttgatccacctagacaatgtataaaaaggactttgatatcagttgaactcaaaaagacacactttgtgttttttttagtaacacacatcgtaatctatctcccttgagattaatgtgtctctgtccaagtttgctaacatctgttaaactcagttttcccccgtggggccttccccttctttttttctctatcttcctgcctcttgaaatctacatctctgaaatcatgggatatgtctcttaagctatgggtttccctggtctcttcctactaacaccctcttcccctccctccctacttccttcccttcctttcttatctctttcaacagtatttactcagtgtcttctctattctaggcattgtatttgctggagtctccttaaatttctgtattttctttcttctccaggccaagtaaattatgtctttcagtctaagtatcttcctatctctaggagatgatccaaggagtcaaatagccttatcccagggataaggatatttctgtgccagtcatcccaagagacagaggccactgctttcatgtacagcataaaaacacacccaaataatttttaagggaaaataaatggctcccatgagtgatccatttgtagaaaacagacttggctaaaacagacccagttacgtgtaatcagggtacctacctattctactgtcccagaattcccatatctgtctcttgacatctgttttaggaaaaacagtaagaaacaactaactggtctgatcagccttgacagaggcaagctgaatcacagcatgtgttcctctgctgaagcaacatgacattaaagccaaatacacaccaatgtcagttgtgacacagtcccaaattggaagaaattaaacttgccatcaatattgtggtagaaggcaatgggaattgctactggtaatggttaatgttcatttcttcctgttccactttctataaacaaggtaatgcctatacaagctcattactgtaaactgagcacatttaaattggcagtaaaaccagagtatttactctagtgcacatataaagtgcctcatccaatgttttggaaacgtttcaagttttgaaaccaagcagctggcagctttacaagccaaaccttacacttaaatcattcactctggaaagttttttggtgtcctgtgtcaggtagtaccattcagcagacattcattcccccaccccttgaattcttttgcaataagtttgcattcatggggctcttataactcttccagcaccacagactccaatggctgttgattaaatgtatatatcctgtgcatttaatctgactttcattatggccacttcataaaaccgccacagactggacaagcgatgacacatagcaagaacctggaatccctgcaaagtctcagattagttttttttttctccttctttattaatagtgaccattctgtggcctagctctaaatcagcaaaagtatttgacagcaaatgttcctatctatggattatatataacccgtcctaaacaccagatgaaaaagggataaccccgggaaaggaagggcttgcttccatgtaaatcatgttacaaattggacaacacccagagagttcattgttcaacctcaattgtgaaggccattcccatttactatccccctggaatcgatgttaattaaggcaggctgagaccataaatcagcttgggagttttacaatgtaattcagcattaagcatatatatttaaataaaaagtaactgattaaccactagagtttttccagaagttgctgaggccatttctttataatagagacatgtcacctttcatttttgtgaagagaggaaagaaatattgtcttctaaaaaggtgagttagggctagttaagtgactcacaacattgattattaagaggaagggaggagctgaaaagagaaaagaagagaacaaaaagggaggggagtcacatgcaaaaggagaggaagttggcatgtttgtcctagctccctagaagtcattaattcttcctttatttgcaatcatttcttagtcacctattatatggtaggcactgtgctaggcattggaagatataaaaaagtaaatgataatcagccccctgcccttgaaataagtgttcagtactgtggtgggggaaatcaacagtcacggttctaataataaaatttgggaacaacattcacaagcacttattgaatacctactatgaatatgctccaaagataatatattttatattctaattgtataaaatatcagagaggcaatttgtgtgtcttaaagaattccagccaaagcaaccacacctgcctgacagaagccaacagaacacctctctgcatattctgacgaagtggccttcatcaaagaaagcactggctctctgaatccacagctgaagaggcagaattgtttgataagtacattctttctcaagagctgtgctaatagaacacgtttactcaggtccaactatacgatgaatcataaaacaacctgcagacagataatctagggagcagaatttcctctaacccaaagtacatggataacacacattcagtaagtaattcagatacaacgaacgttatgaggggcccactatgtactgtgaactttcaccatttcatttcatctagataacaaatctacgatgtaggcattatttcctgtctaaaggaataagctaaagtttatgatgtaaatccaagttcacaccacaaataattgacagggcaaaaaacttgaacctttcctctcaacatctatggctgttccccgtctcctctgctaagatgtaactttaaattaaagatctatattctattaggccaaaggtagtagaaataatataaataagaaacttactataaagtcagaattgaaaaccaaattgagcaagagaataataataaatgttaacatttgcgtgcttactatttacaggctctagacactttttacacatattaactcatttaatcttcacatccaccatatgaagtaggcagtcatgtttgtcctgtttatagattaggaaagtcaggcacaaaaactaaaatgaacttccccccagttaggaacacagtagaggagggttcaaaatctaaatagtctagcaccttaacctcagtcctagatactagtatgtgaaacagggtggtgccctggagcaacttccttcatgccgcatgaccttcaagtggccatctgtaccatttcaaaataaattaatcaaatgtgtttctttccaaagggttagattcctttataatctgatcccaaacaatctctccagtctcatctctggacactcatcaccaagtatctatgcctgcataacatttatacaacaccaccatttatgtaaataaaacatatagagaaaaaataacactgtgttttccatcaataatatgtccatatctaaatatagattggagtgaaaacctgtgggggaaaccagagaatttgcacagaccagtgtgttacatgcgccataaaatgaggagcatgataacttaaaatctgtggatctaagtctctccctcgcttagttcattcaagcttctataacaaaataccatcaactttgtggcttacaaacaacagaaacttatttctcatagtcctggaagccgggaatttctagatcaaggcactggcagattcagtgtctggtgagggcccactttttggttcatagatggtgcattcttgccatttcctcacatggtagaatggacaagctagctctctcaggcctcttttacaaggacactaatcccactcatgagggctctgccctcatgacctaatcaattcccaaagttctcatctcctaatactatcacctttgtataggagtcctcctttatccatgggggatatgttccaaaactcccagtggatgcctgaaaccgcagacagtaacaaactactggtatagtaatacatactatgtttttctcctatacatacatacctaggatcaagtttagtttgtaaataggaacagtaagagattaacaactagtaatgaagtgaactccaacaccatatcgtagtaagttatgtaaacgtgatgtctctcaaaatatcttaccatactgtactcacctgactgtggaaagcaaaaccatgaatggggtggagggactactgtattaggatttgaacatatgatttttggcgagacacaaacattcagactgtagaagtcccaaccccctctcaaatcctatattaaaactaccaatttctaaacatgacatgaacttttgtgagtcaggatatttgaacatactgtttcctgccttctttaattgacaggacagtaaaatcttagtcatctttcaaaactgagttcatatacgacctcttgataaagccttcctaaatcccttcatacagagctaactgcaggtcctctgacatatacctacctatcatactgtcctgtaatactttacctaaaccctccactgtattgcttgctccttaagaacaaatactatgccactacgtcatctttacttttgtataaccaacatctacataaggaacagtaaaatagtagatgcccaataaatgtttcctaagtattgatattacataagaagcaagtatgaattaaaaacgtacattgtttcttccagctaaaagcaaaacaatgtatgttttggattccaggagtcaagtttcttgaaatcctagaatcactttcatctcatgtcccagaaaagctgtctctcaatctacagtgaataccatctcatttatattgtaggcttcctacatttttcttgtctgaattgaagttaagacaaatagttttcatccagaacatgattctagataaagacactgtggtcaccaagactatggacgtatttactaaaataccagtgccactggtatcctgctaaagcccttgcaaatgaaggtggttcacaaggaactgcttttctctggggcactggatcataacactggagttctcctgagtgacttgaagtctgaaaggccaaattgaattgcagtcttctcacctggccactatcaatgatgtcattttatagtttgttatttaaactgactgtgcattaggggcttatttataaggggatacccttataaaagtcttattttcttctacagcacaggaggaggaggaaaaggaagaggtgaagttgcttgtgttttagtcctggtttcatgctaagtatgtggcaagtcactcagcttctctagccctcaatttctttgtctatgagggtaccagacctggtgactgaaggaaggctaaccatggcacttatgatacaaatcttgtttccaggctcttgacaaacattaataatgaatcatgacactttccagctagacttttctgaatacttttcaatacggcacttcagaaagctactatcaatctaatggaagatgtcatttgttattaaatctattgccatcccttacaacccttgagttctaatattctgtacatctgggttagtggatatagaacacatgtggccaccagtgggcgctcaataagaaagtgtatcagaagttctgtgataacataggtttgatttgttccttctctaaagagtgtatgttaacatttcatagccatttgaataacagaatctccatgactgctgcagagtatgccctctgtgttctcaaatgtgactgccttcttttccaattatgtctaatattttaacacacaatgaatatactacaaagacatcatttgaaacggtgagattcaggtggaaaagagtcctacaacagacatttttaaacctatgccaagtcatcaccaagaacagctggaaaccctccctccctgccaaaaaacggtttttgtttcctgttgtgaaattattcagtacaccaagatcatactttaacagccaagtcctattaaagcactattttaaaatgctctaatgaatgagaatctttttctcggtctaaacatagtagaggctcctttggttaggaagagacagattcacagagctgtacagggtcttagatataatctctgcaaatccaagtgttagataaataaacttgtcaaaagaagtccaatggcttgaccaaggccacataccccggatttgtggcagaataaagaacgaaccccccatatcctgattcccacctcagtgctttttctaaacttaatttttgctgatgtctatttgaaaagaggacttgatggctgaccagatccgagtgatctttgctgcatctctatcatgatgcttcttttttatttaagttctgggatacatgtatagaatgtgtgcgtttgttacctaggtatacatgtgccatggtggtttgctgcacctatcaacctgtcatctaggttttaaaccctgtgcacattaggtatttgtcctaatgctctccctctcctgcccccacccaccgacatgccccagtgtgtgatgttcccctccctgtgtccacgggttctcattgttcaactcccatttatgagtgagaacatccagtgtgtggttttctattcctgtatcatgatgcttcttagacactgttcagcacaaggaattctgtttgagtccttttacttcagcacaatcaacacaggtgccagtaaaataatttttcattttctttcccgaaagcaaaatatgttagggaaactgttgatttatattcctaatgaaacactacttagagatgaggtcctgggacactgtctgcagtcttcccaggtgcagaagcagaaacttctgccagaggacagtcaacaaccagactattacaatcctcaaatagaaaattattttcctaggcatattaaggaatagctttgtgctcttccaaccaacaggactaaatttgaggattcaggaagaggacctcaaaaccaatccttatcataattacttcccagaggagggccggttttggatgagcagagggaaaagggaatggccaagctaactgatttaggagctggttacaatttcatggcaacaaagtgagtcctttttcatatgttcccttctctgtagaatctcggtatcccagactgaaaaagaaaagcatatcaaatgccaaagtctttataaaatggtcactgctcaaagggctaatatccagaatctacaaacaacttcaacaaatctacaagaaaaaaacaaacaaccccattaaaaagtgggcaaagcatatgaacagagacttctcgaaagaagacatttatgcagccaacaaacatatgaaaaaatgctcatcattggtcattagagaaatgcaaatcaaagccacagagagatactatctcacaccagttagaacggcaatcattaaaaagtcaggaaacaatagatgctggagaggaggtggagaaacaggagcacttttacactgttggttggagtgtaaattagttcaaccactgtgggagacagtgtgtcgactcctcaaggatctagaactagaaataccgtttcacccagtgatcccattactgggtatatacccaaaggattataaatcatgctactataaagacacacgcacacgtatgtttattgcggcactattcacaatagcaaagacttggaaccaacccaaatgtccatcaatgatagactggataaagaaaatgtgaaacatatacaccatggaatactatgcagccataaaaaaggatgagttcatgtcctttgcagggacatggatgaagctggaaaccatcaatctcagcaaactaacacaagaacagaaaaccaaacaccgcatattctcactcataagcaggaactgaacaatgagaacacgtggacacaggatggggaacaccacacacccggacctgtcaggggatggggggctaagtatggtacgtgtatacctatgtaacaaaaatgcatgttctgcacgtgtaccctagaacttaaagtataattaaaaaagaatatggtcactgctgtttggcccacaatttcttcttccacctaagggaattaaaataaaaattcataatggtactttattagagacactccacacatgcatttgaaaaaaatctgttaagtacaatttccttttgtcaatatttcaaagcgtcttagattctgggcaccatggcaggaaatgtcatatattttcttatctcagcaatttcaccttcctagtagaatgcttttaagaactctaataaggacaatactccctgcaacaaaggctttctgccaataagaaatgtcccttcccaaaccacaaaggaatagatatctcacggtctccaaggaaggtagtctgacatgtgaatggtgcagatggttgtattcctgtgttaaaacagtaaagatcataaagtttggctttttgaaagccaattaaaagtgactacgctggtttatacaattttacttttcaaaagagagcatcaggatagcaaggtaacaagcaagtctgttcccccaagacaggtgtagagttgcttaatttattcatgcttgatggttgaatgttacaagggtcatatctatgtatgtaaaacaaagtaaagaaaaatcaagaaattcgttaaagattgaggtgattaatcttgtatgtattccttcatcttcctcatagaacaacctagaatgggggaggtagagttgaaagatctccattttaatgccagtctgccttttgccacttgtgtaaatcctgagcaagctattaaactctctgagctttgtttcctcctccgtaaaaacagaaataagacctgtctgccttacagagctattgcacaattagtgagataaaatgtgaaatgtgcctgaagtatagctggttaaaatgggagtttctctcttccctaagttcttgaagaaaggtctgctggcttcatttggtttcccccacatcttaacagcacttaaaatgcagtaggtgctcaaaggatatagtaaatcatgtttctagaaaaagtagtggggctgggataaggaattaagattggctgtcaacagcatcggattcttctaaaagttgctttaagttgctgtatacatctcaacagttagctggataaagattcaaaacagtgaaacttactagccatacagcctgccttgcttggccacttttgcaacaggaaaacaagagaggacaaactaggcttatcgcacttgtcagcccacagcaaaatggccataactatataggcaggctgccatggattttctaattggggaatctaaagcctgaggaattctcaaagcagcaggtattgataggagttaggtgtaaataatttcctatcctcagtgaatctttgacataaagctgccatgttttatttcagtaataaaacgttttgtttttttaatagtaaatgcttcaaatgatttgtattaaactctgcagtagattgtaccttggagagttaaattttactcaacttgccattaaactgttttcattcctcataagagagtaccagacagcaaatcaatatccagattgatttatatgaaaaagtttagttaaacaatataaggaagtagtttgaggacttaatggtagttatctccttttacatgattgtcccactgtttctactttaaagagatttaagaacaaccaaaaaaatggcagcgctatcatttacctataaaaaactgtattgatgatcatctcagtatggcactctgtaaggctggtgtcctttaaacattataatcaaaggtaatatttttaactttgaaaaaaattagccccaactttttttacttctaattaagagtctacctatacagagtaaaacaataaggcaagtgctcagatcatttagagagggggaaaaaacttcttcctgaaatggttatatagttagaacaagagtggttctgttgacttccattattcattcgctttgcttcacgccaaaacatctggctaaaaagtgaaaaaaacacccaaatggcattgtatagaaaaaacacctagatgattgattgcatttttcactttaaagtcaatgttttgatattatagggacatgggctttgttcagtaagtgtaatattttactagcaaaaagcatggttttagaaagcttgctttgagaaggactaatttatcaattataattttaaatcaattaacagttttaaataatggacccaatattgcaggccctgaaccccacttatgctgagtcctaagctgaaagtcaggaaaaaggaaaagtcttcactagaaaaggctgctaactagactgctcaagtattcagacagtacaaggtcaaaaaaaatgtaaaactaaaggtaacattttaaaacagctttaaaatactaatagaaagtgattgtgccagagtaagcagctgggtattttaaattaagtgttgtatgcccaacacattgtactgatgttcaatgattacacaaactgtgttaatgctgtaaatggaaataacttaggacattaacagttaggtagccaagatccacctagcttctcacatatccatctaacctcaaggtctgcttctgaaagtgaaaggacacagatgagactacagagacaaaaggtcactagtcgtgttccccagaggacagtttggtcagcctttgatggacaaggccggatccaaatgaattgagaagggaagtatggatgggggatctgcccctttcccagaatgatgctgcttgagatattcagtgttattttgggtcattcagattaaagggtccaggggaattacggtgacctatgatgcagacctagtgttccatttgactcaggattccatgggttacagcaggatactcccacaacagatctaaaatgtccaattttcccagtctcccttaatcaaatgacaggtatgactaacacctgagctgagtctcatggaggtcttcttggactctattttttaaatgtttaaaatcttaatactctgttaaggtataataataagctgtatgtatctgatgagttttagcatatgtacacccatccccacagtcaagataatgaatatatccattccccaccccaccccacaaatttccttgtttccctttgtaatccctccctcttacccaccctgaccctcacattccaaacaaccactgatctgctttctggcactatagattattttgccttttctagaatttcatatgaatggaatcacatagtaagtacccttttctgttctttcactcagcgtattttacaatttatccatgttgttgaatgtatcttgtggtttggttcttttcactgctgaagagtattccatgttaggaatataccaaatcttctttaaccacagaaatttgatgaaggtgtcctaagatccagttgtgcctctattcctctcgcatgatttctttatgggtcatattcctacgtgtacaaagattgctagatggtgtgacttagatgtgtcatttaaactttctgtggctcaattttctcatttgtacaataagataataaaaaccatttattgagtggttgtaaggattaaataagatattggattactgaaaagcctaacatagtatgcactgagactttttattcattctgattctgaatataagcaatcaattcaaggcaatttatgagtactcttaaaaagctagtcactccttgttctgtctgagtattcgttcacttactctctgttgctactaagaccactttgctaaaccagcagagacagatagggtggggaaagaggtaaagatggtgaaggccatccaacacattaactggtctccccaaatgtctgatcactacccacttctgacactgccatagagacaggctaatgcaggctggttcaaacatggtaaggctacctggcctgtagagggtctgaacagcggtgtgggaaatgtactttgagagaagaaaactcaagagaaatggcttttatgtacccccctgtcttgaaaactgagaatgtaacatgatttctttttgtcttctgtttggaaacaaatgttcctctgcctatcttccctaggttcaattagtcttctgtctttctcagaattcagcctgttcatttgcaaatggaagacttcagaaaggctagtgggtgtgagtgtgggtcttgagggggaagggggctgaagtgtttattttcaaagccacgggggtccccatttgaaaaagcacccagcttatctcaatgtttttgtttgtatgattttgaattagaaggttggagcaattcatttaggagattaagctgtttttacaatgggcttagttgccctatttattcaatagtattgctagggttaaaaaaaaaaagtctttctactgtgctcttcattattccagtgtaccagttttaaagaattccttggtttttgcttttaatgccagttaattttacattaaaatgatgtttattaactggtcacagataaaaatcaccaatgatttctctaacagtttagagctgcccgttttagcaaataaaagtataattaaatatgaatttcagaaaaacagtaaataaaatttcagtttaagtatgggaaatcatagggtatactgatactaaaaaactaattcattatttacttaatcttcaaatttcactaaaaatcatttattttatctgacaatcccaccatgttttcatggatgttgtatgtgttccaagaatggtaagtgaaaactaagacaaattccatttcattattgcacttagacttgctccctgcacaggcaaagtacttcatcaaccggaatattaatttccagtttataaacagataaagtgataattcaacaaatcaagtgaatttgatacacaggttaagacctagttctagtcactaaagcctatttcaactaaggaaatttttctcatcacaaaaaaagtaaaaccaaaagtagcaactagcatcttcagttgaattagaagttaatgtctcaaaccactatgtttaaatgtgaatatcatctttcatttatgctgcaaagcaaacatctatgcaaggaagggctcgaacacctcaatgcatatcctaaggttgaagaaggctttgaaccaataaatgagtgatttctccacaggagactaaacatttgcttgtgacggtaaacaaaatgctgaattttatgtagcacaatcatttttacatatctgttgatataagtagttaaagaagaattattgaatttttttctgtcaaatgaaaaggtttgcacttgactcagatcttagcaaataatcgtatttaaagaattaaattattccttaaatgtgatgcttcctcttaccccaggaactggattataatattatttgcagtaagtcattcctaaaggaccctgacttaaactgtgatgataaactaataagcctaattgtgcataatttatagagttcattttaaaatcacatctaacattttgagaaatttttgtacatcttaaacttaattttctctttttatttatttatttttttagataggcaacttcccagaaaagaaaaaaagaggaaaggagacaaatgaaaagctcaaatttggtcaagatccctatttgccatttaaacacaacattagaaaactcttgctaggactacattttgaaataaacctcatgttggaggtcagttctgctaagaaataccactgaaagctgccacttgacccggaattcctctacaagaaaaactagccataactacatgagaggcctatatgagaaactgccagaatgtcaacttcatttgcagtggccccatatggcctgatcactctccctggcatgataaatcactggcagaattcttaccttcctacgtttgatctctgctcagcaagatgtggttttgatgtgaagaactccagatctcttaggtcagagacaaatagcagtggcactgacctgcaaagtgctaagtctctattagactcaagtgaaaagctgtaagcttctgacaagttcccttgccaccacgcttcctcaccctccatggttttcatgagcttagcttggcaggaaagctgctcaaatggtctggaggagaaatgacaacaaatattttctgcctactactattacaaagtattaaaatcaattttcaccaagactcaaaggaggaagtctcttgggagtcactgctctaatttctaatatggtaagtccttagcaaatatgaaacattttgatttccgctggatctttatgacactgctagccactcatttatataacgagaatcattaacagggatttctgtggactactctttggtaaccatgagtacattgttgagacagtattttcaacaaaactgtttgagtgcaaattttcggccctaaaaagaccacaactaaatatgcaagcagttcagtattgtctttcagatgcccataatcccaagttctgggcccaggaaagtagagttctaattagtcagggtggggtaaagaaatcttatagcttttctaatccaacacttttaaaaagtaggtggattaattaataagcatctcattctggtctctcattttgtaagtaacaaagctgttaccaggatttattttttattttttttattttttgagagggagtcttgctctgtcgcccaggctgcagtgcagtggcgcaatctcggctcagtgcaacctctgcttcctgttaccaggaaatttaagtggcgtacccagtatcacaaagcattttcatatttccaggtcccattatagaatagataataaatgatcaagttattttgttcattcgctaattcaataagtatttattcaatgcctgcatatccaagaaactgttaaatgaacatacataagtgacagagctggggtcagaacacgggtcttctaatgccctgtccagtgccttgttcactgctctgcaaggtacactgaaaggtttctatttcagaggaaggggtaaatgcgtggcaatgaagcagaagagttttccaaagtggatgtgtgtataccttctttaaaggaagcacatgaaagaaatttgtttcaaaacactttaccttggaattcactttctagtcctggcattttaactattaatgactctgcaaatgaaatcagacaatttattgtctaggatgtattcatttattcattcatcaaacacgaagatgtatggaccacactctgtgtcaaggcagccatgataccggctctcataaaaatttaagtccaagaaaaaaatgagtctacaaattaaacagtaattggatcccttggagtgacattataaaacacacagtacttaacagtaataataaagttcgaaataaacctaaaatgccacatttaaaatgcttcttctaagagatttttgtgttctgaagtcatgtgtgcctatcactgaaaatgacagcagaaatactccaaaaattgtaaaactaaaattggtgtggaattttagttcactgaaattataaagtgttccaaaaaagcaaaaagcatgctatcattttaacagctgcattatttcaacagttgtcccctttacaccactcacaattacagacactcacaaataaggccctcatctccgtagcaataagttagtgactttgcaagcattcagtgaaagcaaaatgtttggtttgttttttggctaagtgtactttatgtacccctatttatgcatacatgcctatactaaatgctgagcaatcatctttctccttaaatcagatcatcaggagttccaaaaatcactgttttgtgtacttcttttctacgccctctctttttctctgttggaattcctggtaatgataccagaatgtgggcaaacctcattagtctccctgctgtttacaagacaggatttatgctcaatgtgctgaacacaatgacacacatcactaaatagctacaactaccacccaggctttaatctcagaaatttttcactcagtacaaatacctatcagcatggagaaacatggaagagcaattacagccaacacgtgtagtcttttaagagtacaccaataaatacccatttgtgaaggttaatttaatgcaacccaggctgttatctggaatagtatatgtcgccaattcaatccattaagtaattactaaattctcaggagggctcccagaagtcaaatgtggttattccaggttcattgcttctggtctcccaaaggaccatttaggccaacagctgggagagccaactacaaaggttcccaggcataactaaccatttcatgcaaacaggtaaatgagtctaaacgagaaataagagttatcaagtgcctgtcctaagagaaacaccaagggaagcagaagagaagcacaaaaggggaggaataaaaaaggaaagaaaaggcataagtttggtaagtaaaaaagatctgttctctctaaaagtgaagtcagagaaatctggagattgcaagatctggcttaaaggacacaacctttcagcagtttctttagagaggatttttcaatcatttataatgaaacattaattgtgcaccccaaatgccacccctttgtgttgctgaaactcaaagtttgagtactgcatgaattcctctattctgcctccccactgagattacaggtaacagagggatctgatagtaattaagccttagtaagatgattgctcataagagacaagatggaacatacccacccaactctttctggcaagcatctctctcacagaaattatagcccagttacacaaaatgatggcccactggggcacagaaagcattagaaagaatgtaaaatatattatcctcaatagcctcacacatcctccctcccaagtcaatcttaacagccataaaaaaagaaaacactttttgaatgcaaacaaaacagatcaaataaacaggtgttattaagggcagtgtgtgactacacaaccaatgaggattgaaaaacatcgttctttatcataacctaaaaaatcacatattcccaggtgatgtatacctaaagtgtcaaattgtatcaattctctcctttttttaaattcatactcccatttttgtctggttggaattgttgcttatgatagctgcggacaatactgagtggaattagacttaggatctgaatgaaatatgggatttgtagttgaggaactgggcttggggtttcctatgaaacattcagcaaggctttaggttaatagtccaaattgtattgtctttgtagtggttattatgtttgtccttattgttacgagtagggaaggaggagtattgagtcctggaattgccacccactattgctgttgagcctgaaaaaactaactttaatatgcttgattttctcacttataaaatgaagatattaatacaatatccacatcgtagtgttgccccaagaatttaatgtaatcatatgtgaaaagtactctgaatattgtagtattaataataaaagccgtagctattaaaatataacaagtattcattaagaaaacattcttgaagtttctacattgttagacattgagctaggtacttcagaaacaccatgataaataagagtttataatctagtacagtttagaagtagggagttacacagaaaaatataataccatgcaaaaattgtaccactgagaagtgcaaataagtaatatgaatgctcagagaatatacattcattatcaaaaaataagtgtgtagccaaaattgtcaggtgttatatgtaagtatatacacagaaggggtagttttagttttaaggttggagaatttcacacttccacaatattttctttaaaattagagatacacatgtatgaaccaaatcactgatgaaattcaaacacaaaggtaaatatatacaccagctttgggtttagaacttaagttaaaatgttaacaaaataagaagtaatgttattttcagacctggtgcttaggaataatttaaattctcttcactaacaggatgaagtatattattcttgaataatgtagagttattcaaaaaaaaggtcttttagaaattctttttaaattatttgctacctatccatgttttctccaaatctatcagcagcacagagtgaataattcatcaatttatcttgacccttcaaaaatgagtgttgtatgtgtgtgagagacacagcgcgagcgcacatgagcaagagtacaaccacagctaatatttaagtacttattctgttccagataatgtaagaaaggtagggaaattaagtcttgacatgaataagttataataatcatgttaccctagagttttatacagtggccgcctagaggtaagtttgtggaacacagcactgttcttagtttagggaaactagtgtgtattaaaaccatcaatcaaagtagtttctcctattttcccattatagagaagaccacacattctagacttcctaatctgattccaagacttcaaggaatacaatttttaaaaattatttaaacatcaatattgtttgactttccaatgctacatcatttgtctttattattgtccccatgcataagcaatgaccaattctaggaggtaaagacagaaatgcaaaaagcaaaaataaactttctgaagactacaaaaagaatgccttgaaaaatctgcaataggaatgcatttctgaaacaggactctaaaggaaaaatccttcttcctttgcatttaaaactgtatgacagttacacaagaaaaagaagagggaaagttacaagaggaaagaaaatgtttgcatagtaaataactgataaaaattataatcctgaatacatttataaaaactgataacaaatcagtaaatacacaacatagaaaaatgagcaaatgataaattagccaaaggaggaaaaccaaacggccaacatgaaacgatgctcaatctcacaagaaatcaaggaaacacaaatcaaagtagcaatgagatgccatttcacacttaccaggttagcaaaatttaataagtatgagaatctgaagtataggtgaaaatgtagactaatgggaactctgacacactgctggtgggatatactggaggtgtacatactgggaatatactggtggtggaaactagtataactatgttggacagaaatttggcaatccctaattaagttgtagatacatatactccatgagccagcaatatcacttttaggtatacatcctagatgctctctcaccaggtatatgaggagacatgatcaggaatgtccaatgcagcattactgcaataacaaaatgctggatgcatcataaatgtcaagagcagaaactaaaaattaggatatattcaaagaatggaatactctgcaacaattacaatgaactaattataagtacatccaacaacatggatgaatactgaacatatgtttaacaagctaatcaaattacagaaggatatatatatatatatggtacatatatataaaacatttatataaaagatgttaccacgcaaaacaatagcatgtattatttatggatacatatacctatagtgaagataaatgcctctggcaaaggaagagaaagaaagaaatgggggcttcaatttattccttttaaaaaattagaagcaaatactgcaaaacattaagaactaacaaatctaggtacaggtacacacatttgttatattactgctttacttttctgtatgattaaagcaattcattttctgtcaaatatgtctggcaatagtgtgctgttcttctgctgagctggaaacatctctatcttctgaatcctcattcatctcaaacatttagcatcttctatcatgaacaatagctactgtgtgcatgaccccactccacacccaaatgggaatcctctaccgcctcttcagagcaggggccacacctatatatctttctctgccagagtgactcacaatgctttatacacaaaaggccttaataaatgttaaatacacaaatgaatacataaattcagggaggcacaagagtagctctggctacagccaaaaataaaaatgaccctgagataataaaaattaaaattaaattttataataaaattaaataatacaattatattatcaaactgtaaaacatagatgaggcagaattcaccagtttcagttttattggggattttaaccaaacagtctcacactgattcttcatcttctcccaaaaaggattctgccagcaagtccaattttcacacctagagaaataagactttcagttgttctccataaattcatacaggcatttcataatttcaccttcccaggcaaagccttcccctcctccttcccacctgaaatcgtgccactatcacacacatctcagtctggaaatctggtatatgagtgttaggagtgacaggtggggaaaaggggaagtaggttatttttgcatatctcgtgggcttgctaaataattagtgggtttcctaaactcacaatatttcgccagattcatttactgggaggtaattccattcttcttgtgggaaagagtcacacaacctataccactttctgactgtttaatctttaaggaatcactagaaatgatattcaaaaaaaaaaaaaaaaaacctaagagtcactggacttgaaattcaaagtccaatgaatagatggatgaaaataatgtaaaataaaatatattaaaatataactttttaatattttgaaaaatgtataatcaagattggaaagagttttcagattcatgatatgctaaattcttctagataagaaacaggtgtttccagtttgacctaaacaaaagcttttctctttccacagttgtagtgataaagaaatactactttggctctccaaaggtcagacagtgatgaggaagggaaacagagcaggtaactacttctggaggtaacagagctgaactggagtaaaagaaaggcttccttctataataaaaattagaaagttcacacgcagacatactaatttttaaccacattctacagaggtcaattaatccccacgtttagccccagggaagtgttgtttagagcccagcagaagtctaggtggtgaaatcacccaattattattccaactggaattttcaaagcctggaagtgttttcatcatgtgatccaacagagacttgttgtaaataaacctgctgtaaataagctctaagattttgaaggaaaacaatttaaacataactcaatcttaaaggcagacagtagagaaataccagtgataagtaattcccaatgtgcataatctcatatatttaaaaggttaaatgaaatagatctcaaagatacaattaaaggcaattaaaaattaacccaggtgacattacagcaatcacctctacgtgaattagatttgctgtttggggggaaatgaatggctttgaaattacctgtcacagtcaataaagaaattaaagaaatgctaggagggctttcaaaatagccacggcctggtgcttttactttctggaaggtgactgctcctggaaaatgctctcaaaattccatatgttatcttggacagtcaggactagtaaaagtttcttcgtttttaaattatataaagtaagataccttcccactgtcaaaaggtatctaccttctgagaatgtccttgtatgctgcatacttcccacatttatgtatcaatatcttgtatttttatcctaactacttaaaataccagaaacgtctatttgcaacctggagtttaggctcagctaatcgggcatattgaagcatattcatgctatattttggcacaaatgtcaagatatctaattttattattaaaatactgtcagagaaaatgctttagtaacttttttagtaaagacaagaccttggtggaaaaccctcccaggaatcccatttggtaaaaacgcagtgtaaatatataaggaggattccatagctacccagaatattgaactcttatgagtaatgcacataataaatgtaataaaaataattaaaagaatacataaaacagaccggttttataaaactttgttgatcatataatttttttgagatgaagtttcactcttgtcgcccaggctggagtgcaatggtatgatctgagcttattgcaacctctgcctcctgggttcaagtgattctcctgcctcagccttccaagaagctgggattacaggcgtgtaccaccacacagctaatttcatatttttagtagagatggggtttcaccatgattggccaggttggtgtcaaactcctggcttcaggtgatccacccgcctcagcctcccaaagtgctgggattacaggtgtgagccactgcgcctggccagttgatcacataattctgatcttccttaaaattggtttccattaatttagatctctaaatatatatatagtcatcactttgcaaaaatgcaatagaattttggctatcattatatgccacttactttaacacacttttcatttagtccttttaaccccataaagtagatactattatctcaatgatgacaaatgtagaaattgaaagtcagtgaagaaactctttaagatgccacacatatctttttttttttttttttttttttgtgctgttgcatccctaggacctggcatcatatcaggcactatgtgtcaaataaatgtaactgtccatgtagctgataagtacctttctgaccaggatttgatcaaaggcttattttaactcagagtctctctttttccaaatgaaggaagggcatgcaagttttttctaaaatgtgggctatatggtttctgtggctctgccattatagtcagaaagctgccgcagacagtatataattgaatgagtgcagttgtgttacaataaaactttatttataaaaccaggcagacagtccacagtttgctgacccctgatactgtcactaagataactcaagagacaaaaactcctatcagtatttgtattttattgtccaactaagaaagactcagaactgataactctgggtgatgggacttgggatatttactgattttgtcatggttaaatcattgtgcttcattgatgcaacagagaactaactatgcatgatttgcctttcttaagcctggctatgaggaagtcagacctcacaaaacagtctcctcagagaatcctctactctgaaatacaaaaactatcattcatcattttatagaaataaagaacgaggagtccctcagcaaatgataattccacatggtaacataggcccatgtagtggaagggatcagggcaggaccccaggagaattatctaattcaagtcctgtgatgaaattgtccagcttccctgtgttaaatggagatgatacaaacaccaaaaagctgcatagttatgaaaaagtatttaaaaaaaaaacctgaagtcctctattaacatgtagtttgactgacaatttatgaccaaaacagacaatcttaagtaaaggtttggaaggatctagatccacacctatcttttaagaaattattcctggcacaggcaagaatcttgccccagattaaaaaaaaaaatctcatagaaaaatcaaaaatagccatttaaagtattagaatcaaaagtcacaaaagatagctccttcttaagaggggtagactagttcatattttctccatggttgcgagagaagcaacacaaaatataaagatttaaactccttccctcaaaaaaaaaaaaaacaaaaaaaaaaaaaaaacggaacaaaacgatgaaaaaacaacgtgccacagaccgttagaaaaagtgtatggtgatgaaaactatcaatttctttaaagtcaaggccaatgtctttcttatgaattattctatttatttctactctctctccttcaaaaggttttgcaaggatcaaacaagatatatatgaaagtgctaggcagaccattaggccctataaaaatgtaagtggcattataattatcatcatcattattattacattgatcaactgaactactgctgtactaacaaccaatttttggcacacaaactttttaataagaccctaatctcccagaaggcagatgtttccagtctaacacagtgaaaagcacccctgttaggaacatggccactcaaatgccttttgaatttaattgaaatagaccccagaaaacagaagtttaaatgaataaataaaaagacaaatctagactcacgatgcacattagctctgagttttaagttgattgcctttttgcctcttctattttagcaggtcattatgttataaataccctcttcctccctgtgtttcagccccatataatatcagatgcagaaaaaaaaaacataactctttgttactgttagttatgggcataaactctcactgaaaaagtgaccaagagaaagacagcacaacgatctgggggagggaggaaggaaaggagagaccggtacagccagaagagaagatagagccaagaaagaaggtcgaagtggaatacagaggacaagtttccaaagacctgggaatctgttaagagatatcccctgcagtcaggggcggtcagtaaagtgctgagccttgactttgtaatgtgtgtattcctataatatcagttatacaaaattataaaagtcagactaataaaatagacaactcagaaaattttaaattcataaacacatcgctcaaggcaatcagaatgcagtcttcttaggatacaagcaaaggagagcgcattctcttggtaccaaattggtcccctcaatacttcatgttagttttcactcctccttgactaacaccatctagttttaaaaagcacattccttcataagggatcacttttaaaacttgggatccagcttgctgtattagggaaatacaaatagacatgttccaaaaatggtattgccattgatcattggtataatatggatactagaatttcagagtggtaagcgtattttaaaaaatggaatgtaactgcctaaaagtccatacacaaccatgagtttagccctttcaacatccttagggaatgaactttaattctggagcatttccactggacctctagcaggcaaaggcagtaacttttaattctggtcatctcccccattccctttattaaaaatgtgaaatacttctaggaggaggaggaagttggagcaaaaatacagaaaaatacaagatcacaagtacaaagttttctaagtgcacattacttgaaattctcatagtctggtcatttattttaagtagtgactctatgtgggtcccaatatcacactgaaaaatcatacagaaagtcatatccttcactaaagatgtatgtttagcaagacaaaaaacaataacatattgtcttacagtatcattttctgatgcaaatattgtgtttctttcaaatgtgatatttaacacgccctaacgcgtaatacttttgtagccattacccttttaaaatcccctatcgaatatggtatcactatgctaaaggactgtccattctatcttgttcactcttctgtttgaaattgctaatataatttccctcacttctggtcatgtttgtttttaaaaaactcactattaatcttatttttcctttaagtaaaaaaatcattaccctgggataccaaaagagcagcttctgctcttcacgtttaaaaaaaaaatactgcttgtccactatgcttgtcttagaaaatttagaagtctcactaaagagctgaggaggaaaactgctgggaatgctcacagatacctgattttacaagtttttgtggaaagagctcgcctttagattagtgttactcagtgtttatgagggttgtttgtcaaggcaaaaataaggtacctcctccccacaaattaaagaatcaagttacaatccattatttcatttctgattgtttttctttgtattaagtgggaaagtggatactggataaaagttccccgagctaaaagactccacattaaaggctccaattagctataaatcagttgtctttcctactgggggagaacaagagagaaaagagagagggggtagttagggagtaagagaactggaagagcttccaaattaaattctgaaaaacgtacctattgcatacctaaaatttctttcagaggctgttagaaaaatcccatcaaaaataagactaaaatcaaaccttcccaaatctgagggttaggtcttttctcctgtgtagatcttccattttaagacctttaaaaagagcctgaagaggttagagaccctcataaaataaaacttctaagctgcatgctttccctgctcgttcctaaacccagacaagtgccacacattggcactattgttatgcaaacaatgcctaaaaggttataaccattaacgacctctcattaaaacggctttgaaaaatttgtcacaccatctaaaaaagctagcaggtacattaaatccatctaaatcgacattcaaaacacaaatcgccctgatttgtaacctaaaactcaatgcaagtaaaatctcaatattctgatgttgtttcttgtatatctcattcaaccactaagccagatgcaaacaatttacttctctacaaaatttatcttgtaaaaaagcacgatggaatacatctttaatcaacctttaaccatatgcatgtgcgtctatgcgtttgcgttaattgggagaagttgagtgtagaaatgtaccgaaaggactagaaaatcaaaccagagaactacaaaatgaactccaagaaacgtggttttcaatcccatctctctctcaccacctccctcaaaatgttgtaacattacaatacccctacgtttgtaatcgatcattttttttctatgtcgaatttgtggaaagtaaattcattttatattaggtagcagacgcatattcttttttaggcgatgcaacaacaaaaatcctgcttagcaaacccaagatgtcaacgttcgttataaaaaaaaaaaagtaagttcttcagttcaaaaccgaacatgctaacaaatattaaaactttttaagtttcccagggaaactgccgctgcctacaaaattcacatgaaacgctgacgttggagttactgtacttatcagtcaggtttccgtgaaatttgtcaaaccggccagagcgctggtgtcttgacaattccttacgggaaagcccctcagcaccctccgggctgtggaggacctgattgggaccaacagccgaggggcccggaaggcggaggaccgagaggcgacggccaggctgcgtggccaagctgacggggaaccccggcctccatctgaggatactaagcggttccgacgccttcccccgcggcagtcgggaccgggagaatcggacagaaaccagcctcagagtccggggcaggagccgttgacggctgcccctcaacgctgcgcttcgggttgggttaagtccccaaggcgtcctcagaccacggcggggcttcaaacgccccagtcccgaagacaggcagggggtccctctgctgcgccgggatgacaggctggccccgacgaccccggccccgtcccgcagccctcacccgctgaagagatcggggaaaccgaagaaggttctagaaagtctccgtggacgacgggcgctgggcggccgcttaccttggtgtacttaatttcgagattgggcgtgggcgacggcaggaggtgcagcgacgccatgagggcggcggggtcggccttcacctcgccgggcatctctatcttgctggaagtcatggtggcgggccgggtgtccctagcccgcggcgtggggcagtgcgggctgtgcgcgcggtccgcggcccgggggcgcgctcgcctgtatataggcaggtgtcaagctggggctcttcttattggacgtgagggccgaggcgcggggggctggtccatcctacctaggacgcccggcgcagcctccatttacataaagcccgcgccgcgcggccgggacgcttggcgcccacggtcaagtccgcccggcgctcccgccccccggccgcggagacc

SEQ ID NO: 2389 - DNA, 112501 bp, Homo sapiens; identical to SEQ ID NO: 2388

SEQ ID NO: 2390 - DNA, 112501 bp, Homo sapiens; identical to SEQ ID NO: 2388

SEQ ID NO: 2391 - DNA, 60675 bp, Homo sapiens
aaggagtacacaatataaatgctttattgctagcacagaggtttctttttaagtaaattaaaagaaataaatcttcattttcacattttttgttgcagtccaaaggtaactagttggttagtggctatgtccacttggacacatgctacaggagggcagcattcacatggaagcactcagaaatacggcatctgtcagggctcacggcactgggctgctgaatgcactgtcgtttgtaaataacagcaagtggagactttaaaacatcatggatagataagagttataaatagaaaactggtacggttaagaagcagaagatcgttaaatacagaaggctatatatatgttgcccatattccacatactctgggttatgtttggtacttttaaataaatgatctgcatttaggttagagactggattggatttgacagctggaaagatggaagaagggatggaagaaggaaaggaagctaacacttcccacatcaaactggtggagtcactggaaagcagaagaggagtatgtggatgggaagaaagggaggcgggcctgctttactccctgcaagctgtaggccatggcctgcccagtgaggggcaagaatggggtgtgacagaggagctcagtggagcacggcagtcctggcacaatggaacttggcaaatggaaaaggaaacccctaggcttggccagattttccaaggtcactgccaatagatacagggcacattatgatagatgtacagtgtgacagaccaaaatcacacctgcagcagttattggtgtagaggttcagaaggtacagattccaactacagaaataattcatttaataataattgttgcccaatattagaaactgaatgatgtctgcaaggcatccagcattatcaaattcttgggcctactcggattgttttttggttggttctaagaaaaactttggaaaagatcttatctagctatgaaaaacaacccactccttgccttattccagaataactgagaaggaatctaatacacacacaccccaaaactgcagcaagctcagaagcggtgaactgcacatgatgacttccagtctctattgtcccaatcttttttcattcatgttatttatgggtaaaagaaaaccagattgggtcaggaatatcccaggttcttactacatctgtagtgtaccagctcctggcattttcattctggtctgactctagctaaaaccatttcatgttttgctttgaagaaatggataacatgaaatgataatttggctttacaaccttgaaaaattgttcccggcccaaacatctgccccagaatgagctcagctgacatctccttggaagagagggaggggtgggtgagcgaggagggcctggaaggaggaaaatgaagacaggagaaaggtcacctttccttgagaggaaagttctttgtgacaaagacatgaaataatacagctcccttatttcatcctgtgctccagaaggagatactggatgtgtctgctagctcctcctcctccctttatcccactttccccaatatttggtatgattaaggtggccccttacagagtgccaagaaactgtacccagctggtttgctttagttgtgcagtgacctgcctggcctacatgttatcttttcaatctttaagtaaggaccgtggctcaactttgtattcctgagagctgggccctacagagaaagcagagagggacagacgtgcaggctgggcttcatcctccttcttggccttcttaggagttcttctgggggatctttactgtcaccgtcttaacttctgagtactcccgcaagccaaattctcccctgaaacacagaaatgggccgggtcagataccagaagtccagggagctgcatgtgagtgcagcgggagtcctggggaggtgcagtttatcacctgcgaacagcaagtcctgggatgttcatgtaaaaattcctcacgtatgcgcagcccagccttcctctgagggtcagagaaactgtcatctcatgagtagtttttaaagaagtttttttaaaactttaaagttttttaaagtagttttaaagttaaaaggtgacttgttttcacaatactgcacagacaggcaatgactctcaattactcagagaactaccatcagccttggccagagggcacacagatgaccccaggctgtgctcagaggctgagtgctgtgggcagcggtgggaccaggcccaggtctctgaacgccttggccatgcctctctccacaaggcagcactggttcagtattagttctttgggacagtagtgtgctttcctcccccaagacggagggtgggagtgggttgcatgtctaagtgttcctgtccttctgcgtgtttactacagtgctccttctcctccacatctcttctctattctcctgttctttttgccttgtttaaatgccttttttccccttatctaatctatttcattataaaatcacgcatgttctcctctttttcttctcttcttctgaaagtcactcttcagtgatgcttttcccaacagcctcaggaggagctcctctttcgtcctctctgttcacagagccccttgttcacacctcaaccaccacacttatcacactgggaggacaaggggcttgaatatctctgtcttccctactgagttgtatcctactgatttttctttttgccttccaccaaacatagggtatagcctacaacagcaggcacaaagaaggtacctgatgaccaaggaaggaaggaaagtagagaggggaggagggaaggaggaagggcgagcttcctattccctcttcccaagttctaccctgttgtcatatcttctagatcaggaaaaaataaaaacaattaggagatatatttgaatatgaaacaattaaatgattaagaaaggctgtcttttgaaacagtcagtgtacgagttactgtggctgggctttacaagagagacctgctgtaaatgattcattcaggttccttttaggagcccccatggcctacataaggctccaggggctttgccagcacctcctctgagcaccgtgggcacctgagttgacagggacaacagagggcggccaaggagagactggggcaagcaggctgttctcctgtccgtatagttcatttcgcttaaagcaatgagagaaaccaactgaaattgccccactcgttgcatgcttccctcattaactccactcagtctcggagtctctttattaccagctcagctctggctctctctggtcattttcctgtccttgggcaattctgaatgtgtctcttcatcacggacaccatgtgcatcccatttgaagtgaatttactcctttgtttcctggcttctgcacgcacttgttggggcaggtcgcgagccacacttcacccccatgtgactctctaactaggttgtgagaaatgtaaggaagtctacagcatcagaaacctcacaattatggttgctttcaagtgtgactgttggatcctaccgtttgggtgtgtgatgcaatggaaaaccctgctggagcagagctgctcctctctgggtcctgagcagtgatctgtgcacgggggaagtggactcaaatctgctaccaaaagaactgctctgtgcccaggacatgaaggaaagccagtaagcagtcttagagcagcacgactgaggaggcatggaggagataaagagcactgaagctggggtcagagacaggagtgcccactcagctctgccatgaaccagctaagggatgccagctgagtcactgtcatcctcttggtgcccagtcatctctccagcagttcctgaacctcagtatacataagtatcacccaaagagcttggttcaacttttgattcttgaacgctacccccaccccacaaagattcagtttcagaagctctacggagggaccaggagactgagagacagatggtcatgtgggtcacactttgggaaacatgctcagaggtcattgagccctgaagtctcgattcttaagcaatttcaccatcttgttccaggatttctgtcgcatatttatttactccagctaaattttgtggcacatacagttaacagggaagaagctcactgatgcacgaaaggtatgcatatcattactgatgcagcccaatctctctgtgtggttaccttcacatcaggacgaaacagcaaggcaaaatcacatttagaagactaggttctagtccctaagataaatcaaacttggcacacctagaggctttaaggtaacctgtcagtcagtattggtagctcttcgccagccattttaggactcactcagacttgctcataaaacaagtaagagtttctgtttagggtatatattttcctgctcttttacttgacttgcagcagcatttttcagagcggagtaaagtctccagaccatcagcatcagaggagcttgcaggtggtcaggactgagagggtgggtgggagcgggtcaccggaaggcaggttgctttcaagggtgactggtggatcccagtgtttgggtgtgtgatgcaatgtaaaaccctgctggaacggaggtgcttctctgtgggtcctgggcagtgatgtatactggagtcactctggaagcttgttaaaaacgcagttcctgggtcctatcgcagatcaactaactcagaatctctgagagtgggtccctagatacgcatgcttaacaaaaccatcacccagactggaggtgacttctctgtatgcatgcgtgtacacgcacgcacacacacacataaatttgacaagctctgatttagagtatctaacaatgcttctcattttcaaagccagtgtcctgagtttttaaaatgctgaggttcacagaattctttccatctcctcagtttgtgacattttatggcttgtgctttgccacccctcatctcaggggagtttgataaggaagtaagaaaaaggacaggaaaagtgaaacaggcagaaataggtgggcaggaggacctgagaaaagctcgtctctgagcctgggaattaagagggcagccctccccacagctctctgtggggagacctcgtgggctaggtcagccctcctgggagtttccagatgtttctggaagtgccacttcacgtctctgctcctcttagggatagacagggaggtgtcagggaccaaagctgcatggagtttgcaggccatgagataaataattctgtgtagacggaggattaagtggagtttctgaggctgtatcaaatgaggtggaagagttggggaccaagacagagcagcttcttttatttgaagcattttctgtcactcagggtcatttaagaaagagaaaacatgttttgggggtaagtagagacaaacaaacaaacaaacatgcaatctagacaagatgcagtgggtctcatcaaagaacagcatttcctaattattttttaactgcactgagaaggtccaatcaccatagggcctggaagacaagtagagagaaatggttcttcggtctcttgagcactgttatatgaggttcagatagagccaaactgtctcctggaccacctttctgggcaaggagaacatttctgatgggaatagactagactcagctaatgtaacaagtgtgcccacaatgagggaccatggattagcctgggattagggtccatcaaccagcgatcatttattgaaagtatattttatgctcatgattcaccctgttaatgatctgtaacaaaacaatcaatgcaagcagcattcccagagccagtgactgaccccagcatttcagagactgggagagcacagacatagaggaaggaaatgaaataagaagcggaatgcatcttgaaaagtggaagcagaaggtgaaggtcaaaagcaaatgaagacatacctggagtgcatgaagactctgtaaaagctgaaggaatactaagaactgaacaaatatgacccagattggttataggttctggctgtcagaacagaagttggtgacaccagctggaatttggggaaacttccgccaaagttacaggttaagaaaaagaggaatcatctatataacactaatctgcttgatgaataatgatgattgcagctaacattttctgaaggcttgccagatattctgttggatgtttgcatacttaatccttacacttaatcctcacaagaaccctgaggtaggtagtataattattcccatcttggagatgaggtaactgaggcttagattaagtaatttgtccaaggttgcacaggtagtaatagtggcaggattcaaatccgagcagtgtgattctagaaactgctctaatctccaagctatacctactttatagttttgcttgggagcttgaaattaccagtgaaactatctgaagtatgtaaatcctctgctctagtcttgttggttcactgcatttctcccacaaacacacactaccgttatttttcccgcaatacctttactcactctcccccactgctaccctgttttgcccgacaaacttgaaaatatattcccccttctctatccaagcattcctcttcttgaaaggctgacacaaatccctgtagcagatcatatctaaaggtttcccagatttttccagttcacagtgatcttccctatccctgagctcctccattggtttacagtcttttctgcgattcctctgattctttcaatgttattagttttatttaccccaaaacatattaaatgccttaaggacctgcatcttcctccatagaccaagcacagtgctttgtacatatttatgctcaatatttgttagattgtgaactaggcatttgctcaaaaaaataggcattcagtaatggctgagggaacgggcatgaaacatgtttcctctgtgagtcacagcatttggcaaatacagatcagtttctttcaaaaggagggaaagtgggttcttttcctggatgttacttccaggaaaaacggttacttcctttgtgaagtcttctaggacccgagcagtcaaaattaattgatttttctctgtactgacaaaatgtttaacatacttctaatcatagcctttactacagggaattaatggtacattaattttttccattctcactttgggaaatggaattgtgttttattcatctctataacatgtaatagaacttagcttatagtagcatgtgctccacgaaatgtttgttgaatgtatggatgagtgtaagataattaaactattttttaagtactgctctgtgctgatatttgcaatctatttctctgcaggcatcagcaactttaagacttacatttctctcccatttccagacatcttgaatcccccaaaggggctctgggcatttaaggcattgtaacaattgatcctgaaagaagaaaacatagcactgtgagttcgtgtgaagtctgagcacataatctgactggcatggtatttcttttagaagttttatttttaaattcctttcctccagaggaaaaaattgtaatttaaaatctactttgatttctggatctaagcagtaaggagtgtaccccttttctggtgaactttggttgcttttggtattccccatccttccaaggagatacttgtttatttcaccctggtccctataccaccagtggaatttgttacaagactgactctgatcttaccaaacagtcccagcttgcattgcagaagacactgtgagggccttgttgatgtcattagtaaagacagctgctacgagtccaaagtctgagttattggctctttcgataacttcatccatcgtcttaaatctcaaaatttcctgaacagggccaaagatctgcaaaaagataatatgactcaacatggttgctctgtcattcctttacctgctttccacatttcaatgcaagtttactctgccttgattacttaaatgacctttaagtttagcagtacaaaactgtaaaatctcccaacctttcctaggataagattatgcaagaagagtctgacattagtgtttaacctccccaacttccccaacctctccagcatcacttgattccactgtgtatactaggggtgtcttctttaggtacagaagagcaagtggcatcctccgtgatcctgcaaacactgctccagaacggaatgctctggactgtgggctgatttgctccttgtccctctcttgcacagatgtaaagatgcttcagtggattctctctcctggttaacatcccagtgacccacatttaggagagccgaactattgccagtgtattgttgaggccaatggcaggctattctgattgttctgttggctaataataatcataagcacatagcatgtcacctggcctccacctagcttgcttgtcttttggtttatttttcttcttgaaactggaattttcatagccatgttcattactgttgcaaaatgaatatatgtaaaatataaagagctaaaactctaatatcatccactagaaatgctctagaaatgatcccaagaaagatgtggcttttgtaagaacagcatatttgatacctcctccttggcaatccgcatatcatcagtgacgttggaaaacactgtgggctcaatgaaaaacccctttcggcccagtcctttgcctccacattccagcttggcgccctcagccacaccactctggatgagttccaagatcttgttgtactgtttcttatcaatctgtgggagacaagacttaatgactccaaatataaccttctatgaaaatggaaataagtatgttcttgagaatctttcattttagggtttttttcaaagtttaactacacccagtcagatcatataaaactgctgttacttaccaatttttgacctacaaaaaactggcaattttgtatggttaatcctaatatatcgacgattccaataaatgtactgctctgatgatattgcctaatcagaagtaccagctgaacatttagaaaaatgtttcaaaatgatggagacactggctaatttactattcaatgttcatatgagggaaaattgacttttataattaaatgagtaacttagcaagttgtattgatagtaaaaagaggcaaaaattagcacacagcctttttagatagtgctacatacccaatcttattgtggtttgtttttaaaggaattcctattacacttttagaggaactttagaggaaaatattaacagtaaagagtgaaggatgagcttcctagtccaaaaaaaaacaaggtcagtcttcccccaaaaaactgacggagttatcatttgcttattatggtaaataacacaaaaacctacatttacccaagtttgaatggctcagccagaacatcaatcttctcttgaataatccctaaacccatgctttagtgacccatataagagctggtccaggttccttctgaaaattctcagaacctgtctacagattaaaaccagaattccctttagaaatatgcctcgatgattacggtgaacctgcagaggaggctgttcaggagagactttgtggccctccccaccccactaaagtacacgaggccttcagattaagaaataaccatacagcaaaagggaagtgagccagcccttcacttcctacactttcacaagctacaagggatctgtccagactggttcaggctgctggagagactccttggcagctcgtaaaaggatagatggctctaggaaagaaagatatctaccctccttgactgtggcatctgtagggatgtcctaaagttcagtgattggaaggactgggactgggttctagtgtccagacccatcttgtcatactcatggctttctttagaactgagagactccagcttagtcccaaaggtcagaatattcttttttttttttttttgagacggagtcttgctctttcgcccaggctggtggagtgcagtggcacagtctgtaagctccatctcccgggttcacgccattctcctacctcagcctcccgagtagctgggattacaggtacccgccacctcgcccggctaattttttttttgtatttttagtagagacagggtttcaccatattagccaggatggtctcgatctcctgacctcatgatccgcccgcctcggcctccctaaaagctgagattacaggcgtgagccactgcgcccggccagaatattcttaaagtaatggtaatcccatagtttttcagagataaaacttagaaagggacagagaagcataagaaataagcaatccctctctggctccatttccagccacgaagacatggtggagaataaaggagtcagccgaaaaggaagatgtcgctttgctgggacctactacagtgtacacagttctgtgccagtcaaggattaagtaaacaaagggaatggttatgatttttctacctggggaccctgctcagtggtggggtcaaagggactccccactacgcgcctcttggcccgctccacgcttcttctcacaaactcctcatagatggactcctccacgaagatgcgagagcctgcagtgcagcactgaccttgattgaagaacacaccctggtgggcctgctccacagcatagtccactacaagaggaaacagccatgttctcaccgctttgcctggggaggggcctgtctatgaagccgcctccctcccctctccaaagccctaggtatagtgtgctcactgcatgacataaccatgaatagccctggattgggaatgcaactagttctaactacaccctgacatgctatgtgaacttgaacaacttcacttctttgggtctctttcttattctgcaaacagaggtactgaacctcgtgtataacaggagtctcaaacccctatataccacagggcttgggagataaggtacaggtatgagtctgccaggtggtaaagcaatgtaatggaggggctaagaaggaaagccactacatttaatcattgccatgcataaatatgagccccaggttgccagatcctctcaattttcacagaaatcaatattttaatgtgcagttcttgttttgaacatagtgtaatgtttagacaggtaaacatgtctatattttgtatttggccaatttacaactcctaaatctacagggccttggggctgtatgtttggtacttgggggattaaaccgtaacaccaatgggtcttctttgaagacactaaatttcctctagattgacatggacttgtgtaaaatcctatgataactcttccatattcatcccttatatcttacacttcaaaacagcttaatctgacgtgcattagttgctaaatgaccgactgactgaataaatgaatcagtcaatgttagggagatgaagttcctactcctcaagaggaacaggcataaggattctgattttcttgacaactaatataaagctaaagctgaactctgcaaattccaagctggtgctgaaattcaagcaatctgcttttggttttctgatctctctggtggtgagactgggaaagcagctctgcctggcaacaagtggagggaaaaaaaaaaaagaatcactgaatgagatggtgggatttccttacctggagagcttttcaaacagaaacgtcacacctgtgcagaatggcctaggtggcatccttcctagagacatggggtttctcagttacttctctaagcctctgtaaggtcctactggcaagtggaatcatcccagctttaggactactcataccgaactgacccacgtgtgctgtcatcctaactgaaagtcatgcgagcaacagaaaggggctggaattgactaaacagagaaggggctgtgggtttggaaaatgctggcagggctggtcaagtcggatttatttaaaatggtctaccagccaccaggcacagttgaaaagttacagatttattgaatctaggcagagagactatccttcaggtgctcagcagctgagaccactgctgttgaaccatatgccactgaccaagccttcatctcatccccctattctacaacatcacagattcaaaatggctcattagtgtctagaaaacaactggttcagtcgtcaactgaaaagtgctctttccccattattaaaccattttctccttagaggagatctttttgattgcccttagcttcaaatatcttttgctagtgtcccatcaaaagtggagatataaaagagagcaccaaagggtgtgtggtggttcatgtatgggacctgtagttgacttacagtcagcatcagcaaaaataatattaggacttttgcctccaagttccagagttactctcttcaaattacttcttccagctgcttcttggataagctttccaacctgaaagaagggaaatggagacaggttttgcaaatcctgcaggtgagacagtcaccggccaatgccagctcagggcatcaatgggatgcaacagtaacaaaccctaaaaggcaagccaacccagctcttgtcatcagcttgggttacaagatgtaagttagtggggtacagtttaatgtccatgctggagtgaactggaagacagctttagtttcgtgatggaaggactaaggaaaagggagttaaatctggaatcttaatcactgaaagatttctctaaagacaactggcaagaaaaatgtaactggagatttcaatcactgcattgtggcctttagctttggactccggctccagaaaaaagccaactggtgccacttgaaagatatcatgaggataaaacaaattgttcatgtatctcctaaaatgccaggcatgctttttattacatgctccaaagagactatcaatattacacctttgcctctgcctagagctacagtaaaaggataccagacagttgagaatctctctttttgtgcaatcttgtaaatgccgtttatcttgaatccaagtaaacaagaggctgagttaggagaaagcacttgccaatgagtagactcacattggcaatgaaaatgaaagtgtcataatggaagcaaagatccaccacttagagcccctgctcaaggcagaactctacctcagtgatggggaatgctgttgggagacagcctgcagctgtcacctccttcagggtccacctcagctgaaaagagctcccttgcccaaggagaagccctcttccaagtggcccatatccacccactggtggtggcagggtttgtataaaggtcctaccctttcagcccagcacaggactgggctctgagggacggtatatactccatgatgacccaagtgactggcagaggctgtgtcaggcctgtgttgcagttccacttccccagggccactccccttcagcagggatccctagtaaaatcctgcaagctaaactccaactccgtgaatgctccctgggaacctaacctacaacaggatgcgactccactggagagcacatatcactttatggaaaatgcagagcagagccgccatatagtccatagaggcaatttggtcttgttgagatgaaaaaatgttatttgttcctgaaattttcctgaaaattaaatattttaaaagcgggggaagagaaacgctacattcactttcaactcctgcagtcccttgttgagatcctccagtgggactaacgacttcgcaggcagcggagaaccccagctaggagaaaaggctctggagccagactgcctggattttttttttttttttttaaccagttctgtcacttcgtaactgtttgagcctaggaaatttatttactatctgagccttggatcctcctctgtagggggggataaaaatactatgtacttcagaattatattttgaggattaagtggtgtaccatatatgacacttagaacccagcctggcacacagtaagtgtgcagacatgctaaccatgagcaagtgtgagaagctggggcctcccttttcttccacgttcaatggacagaaatgggggtgatgtaaaggagacagctggaccttccaaagcaggtctcccgtagatctcccaaactgcctgtgctgttaactccttcagaaaaacaccggggaaactccaacttcccctcagtctccaatatcactcattaactgtaactctgcctcctcctaaaaaagattttgaaaatgtatccccatcctgagaaaagctaaccttagggggaaaaagtgatgtctctcaaagatgcagaactagagtttcttgatttgctgaaaacatgacttaccaaggtgttggaaaatgctaacacctggccctgaagtttgatgggtgagctgtggccaacctgccagactgcccttcccccgcccttgccattttgtgtctcttccacttccacgcaaaggcctcaggaagacctggtctcagtaaaggccctgttctcacacagacatggtcctctgagaagaaaacaggcaaacacaaagggaaggagaatctggccctctcttctgggaatgctgaaaattatgactggtaagggggaactcacaccgaagggcaactggggaaacagcaatcctctgacttactgccagcactcagggaggggtgttccctgaggatgctgtcatctgtgactgtctgctcttctgagaatgtcattgtgcttgctcgctccactctgggggaatccaaattaactgatgtggactcattttaaagtcaaggaagataaacaggtaactgctttctcaacaagacaattactggaattcacaaacatattattcattaaattaaaccagtatttattgagtagtctatgttagatacttacaagcattatgtcatttaagcctctcaaaaaaccctacacagtaggttttatctcattttagagatgagctaaatgagttagaagttagtgaatgtcaccaggctccccagctggttcatgacagaacctgttggactatctgcaggctgatgccagagcccaggcctgggattactccctctccttctcccttccttcctcccagcattctgtcatttttctgttctcttttctacatttactgagcactaatgtgtgccacataccatcaaaatcttatccctgcactccaagctgatttcaaagtaggtaggaatatcacctcttctagacaaaaataatgttcataaatcatcagttacaaaacttagattctgccttcaggattatattcaagaaacaagcaaaagccaggaaaaatcatgagttttacacatagtaagatgctgagtaaatatttggggttggcagacactgctggcccagctggcattacatttctgttagccctactccctgatattcatcagaccattctagaggttgatatttttttgccactagaaatgtcggccagtgattattttcatggctatggtaactatacaaaagtaaaagtttcagtctatgatcatcagagaagaatacctaagaataattttccttgcatcaatgctttaccagcctttccttagaaaacaaatttgtgcgctgcacccactaactcggtaaacaccacaaggcaaatctcagatgaatgatacctttccccttcatctttggaagaaagtcgagttatagttcaagaaagaacgggatgtgttaggctatgggagaaccacttccatctggagtggcctcaggacaggacactcctaaacagccctggttttcaccaatgtccttcattcaacacatattcatagttctcctactatgtgccaggtacactgttgggcatagtcccttaccaataaggaattcacagctaaaaggactcccatgtaaacctagtagatgttcaataaatgtggctttgcagtccactagaaaaaaaaatctgggtctcatttaatattagatctgaacagattaaattacagttcctcagtactttgttataacccacaggtttccgaagtcaaagcctgtgggattagaaagtataagaatgaacgaattacgcatacaacaaaggcctaggattgaccaatctttctaaaatggaaaagtttaagtgtggttcctcagggatactgtccctcctgacatgaccagaaggtgggagtgcacggcaagataaaggaggctgcaagggtgcacacgttttccaagtggttaaaagtcaagttaatagagctgtacttgatgataccaagtcctattctgatgaaattggtaatttgtaagataaaacaggtaaacatacagtttgagaaattaaatcctgtatatgatgtaatatagattaaataggataaaggcacagagatcaaatttttagttcgccatcaccttttcttccaagcagaaaagattttacaacgtactcgtgtgatacctcctgccccattgctgacaacctggctaattataaccatatttaggcttatggacgacagtttggcccacaggagtcagaagacctggtactacaaactctggcttctaatgaatcttcaatttgggaaagccacttctcctcctgggtctcagcttctgcatctgtagaatgaaggcacaggccaagcaacaaatctctcccttagtactccagttaattgaaggagttaaaaaagacagacaggactcctggggaccctgctcattctgagagtctgttcacaattcttgtgtttttcttgccttatgaagcagaagtagcttgttacaagtagaacaccacagctgcactgaatgatggaaaaacctcatctttttttagtttccctgcccagagctccttatgaaagagtaagtgatagtgttcctatcatgcagttccttaactttgcactccctgcagagcctctcagctctgtgtaccccaaacatgcaagggcagtgaactgggggctcctccacacataatgaaactgggctaattctcagcaggaatgctggcacagttcaactctgactcccatcctcgtttgaataggcctcaagattgatatcaggagtatccctggaagagccacagtgtactggaatcatgttcacagcaatgcggcaatgtaggggaaagcaatttggggctttgcaagaaaaataatttgttatacaggacaaaaaggaacacaaaaggcttttcatgccctctttattcagggcagttgctccctgaacacagtttctaaagttgggtaaaatttttttttattaattactcaggtgagttcctactcagagctattttattacacatatcaaggtagatttttctcagcgatataacacctttttaaaaatggaaaaatctctactagagatcccagtaaactagttaaagatgcctgtgtcttgtaatatcttttcataaatcccaaacagatttactctctgcttcttccctcttctcctttcttaattttcattgttatgcttcctggttccaactgtgttgggaatagaaatgccaaaaatatggggattgggtgtttgtctttctgaagtacccagaaataacaggccaaattaatctgtccagatttgcaccagaaacaaacaggaccaaggcatctaagcagttcctttaagtggtaacagcagtttaaacctttatctgtgaaattcagattatgaaggccagtataaccactatgtttccagccttctgtcccaccattcccaccaccactcacccacgactctaggcacacaaaaccacttgccctttctggaacatgcctgtgtgtctttgcataagctgctccatctacctgcagtgccttttcaccccttgcttacttgataaactcatttttacagagataactctttcacctcctctgagaaggtagctttccttccctaccctccctacagggtttggtgttccttctctgatctcacagtgctatgtacgtaactctcacattgtgcttgtttaatagctgtctccccgactacaatgactgacttttaaaaaaatatgcatatgtacacagattttaagacagggtctcactctcttgccaaggttgaactgtagtagtatgattatggctcactgcatccttgaaattctgagttcaagcaatcctcccaactcagcctgagtagctgggactacaggcacttgccatcatgcctggctaattaaaaaaaaaaattggtacagacagggtctcactatgttgaccaggtggtctcaaactcttggcctcaaggggtcctcctgcctaggccttgaaagcactgggatgacaggcctgagccaccagggcccagacaaactttcaataatttgttaagtcaataagccagaatacgaaaattgcttgagagcagtggtgtgatcacggctcactgcatccttcaactccttggcccaagcaatcccgccattcagccccttgaataactggggctacaggtgcacactaccaagcctggctaatttattttttatttttttttgcaaagactggggcttgccatcttgcccaggctggttttgaactcctgggctcacacgatcttctggtcttgatctcccaaagtgctagaattatgggcgtgagccatcgtgtccagctaatgttattgttgattgagcacctattctgtctacttgttttcacaaacattattttatttaatcttcatgacaaaactgggaggcaggaattattattctattttataattggaaaaaaagacaagacaagactcacagaggtcaagaaatgacttgcaaacaggcacccactgagtggcagagccaggactggtctcagaatgtgcacaccaagcctcaggctcttctccctcctcttctccagaccttctcctgggaattggttcccctttgctgtgagtagcattttgacagttaaatgcatcatctaccactaacatgttcaactgccttgtacacttagccatccttttgttacataagactctatttcaggtaagctttaaaaatcaaggttttgattgtcttggtctgctttgataggaaaaagcatggagtagtcaagccaaaagtactctatgtcccattaactaggtgagctaaagggatcaacaccttaggacctgctcaaactcagcctgagttttggggagaaagctaactgcagaatctttgacttagcatagttagagaataaatcatggaatctcatccagcaggcagagactataccatacttattcttcagtcttcaagttttaagaattttttaaaaagagaagttttatgctaatagtttaaaacctacacaaccaaaggtttttccacatgaaactggttttttcaatattttcatgacattcaaactggtatttttaaataaaatactgaatgattcacgaatggactcacacaaccttagaaaaaggcctattagctgtttatagctaaaactgtagcaagccacctcccctaacctaaaatgaggggtgaagctaactaggagagagctgacctgattcatgactcaagcagtagagatggtgcttgtatcatgcaacatgacatttatctcacttaggaaataaaagaaccccagctgcgtaaattagaatgagtgataatacagctgttagctacaaacatttgtttggcacgaatcaatctggactctgctgtagtttgctttgatggtctctccactatcttgctgctaatgatgagatcattgtttgttaacctgagtaaagaaaacactataccaagcaaaatgcatattgttttcctgtactttattgaagttgtttattgacttgtgtttataagagctcttttatatttattaaatatttacatgcactgcttatgtatttagctgcataaggagaaattaatcccatctttaatctgagtaaagttgttggctttctaaaggccttttgctttagtaaaatggaaagcagccacctcaaataagcttcttcttgttaactgttccagacactttgtaatgtaccaataggtcccatctccctaaggtaatcacagcagaagccatgttctaatccatatttaagtgacatgttcactctggaagaatctatacaacttctcaggtagcctgcaaagttagaataaatggataaagaagtaaataactacagctgaaaaggggtttggggattatgtgatcgtttgatttgcctgtgaaaattctccatccaccactactaatatggaaattacaaattggcttttatattctagacaaatgccgctctcccttaagtcctttagtgtctgccaataatgtcattccagagaagaaactaagagataacctagaagtcacgggattagttcccctccaaatgaatgtaagcctctctacagagagagaagaatcaaatgtagattctgttagaaagtttagctgaaaacttgctctattcacactgtaataggctacttaatattttaactattcctaaaagcaaaacaattcaaagacccaccttccaccctattctctttcccaaattctcccttctctctctctctctcagttccctattgaatatctcagtattggaagattgcataggtagttgttaatgttttatttgtgaagataaaaaaattcctgttgttataaagctataatagtcaaaataatgtgatacttgcgatgcaacagtcacacagattactgaaacagaacagagagtacagaaatagacccatatagggccgggcgcagtggctcatgcctgtaactttgggaggccaaggctggtggatcacgtggtcaggagatcaagaccatcctggctaacatggtgaaaccccatctctactaaaaatacaaaacattagctgggcaaggtggcgggcgcctgtagttccagctacttgggaggctgaggcaggagaatggcataaacccgggaggcagagcttgcagtgagccaagatcgcgccactgcactccagcctgggtgacagagcgagactccatctcaaaaaaaaaaaaaaaaaaaaagaaagaaatagacccatataaatatggaaaatttatgcttgaaaaaagcaagcatcacaaaggcaattcagtggaggcagggtagtcttttcaagaaatggtgcaggaactattgtcattatccatctatctagcacttggatccttacctctcaacatacacaaaagttgaagtagatcataggcctaaatgtaaaacacaaaactataaaatttctagaaaaaaagcatatgagaaagtctttgtgatcttatgttaggcaaagatttcttagataccataccaaaagcctgatctataaaagaaaatgttaataaactggacatcaaaattaaaaactttaagagacactgggagaaattatttgcaaagcacaaaggacttttatccagaatatactaacaattttcataattcaacaatgaggaaaacaaacaacgcttgtctccaaagtgtgcaaagatttaaagatacttcaccagagaagatatgctgtggcaaatacacaaatgaaaagacactcaatggtagagaattggaaattaaaaccacattgagacaatgctatatacctatttgaatggctaaaatgtaaaagactaaccacatcaaatgttggtggggatgtaaaggagttcaaagtcttaaacattgctggtaggaatgtaagatggtataaccgatttggaaaacagtttggcagtttcctgccctaccacacaatccagccattccattcctaggtatttacctaagagaaaaggacatacatgtccatacaaatatttgtacatgaatgttcatagaagcttttattagtcccaaactgaaaacaatccaaatgttcatcagtggctgaatggataaacaaacatacaacaaatggataaatccaaatgttcatcattggctgaatggctattaaacctgatacaggttgaacatcccttatcaaaatgtgtagaaccagaagtgttttggatttgggatattttttcagattttggaatatttgcattatacttaccagttgagcaccccgatctggaaatccaaaatccaaaatgctccaatgagcctttcctttgagcatgatgttggtgctcaaaatgtttcaagttttgggggcattccagatttcagattttttgaattcagaatagttaaactatatacccataaatggactactacttggcaataaaaaagaacgaattgatatgcacgacatagacagatctcaaaataactgtgctgagtaaaaacagctagacaaaagagtatatactatatgttgccatttatataaaattctagaaaatgcagataatctatagtgccagaaagcctgggaatgtgggggtgggggtggagagagagataagacagagagattacaaaggggcactaggaaacatgtgagggtgagggacatattcattgtgaactctactgatggtttcacaggtagatggatacacatggccaagacttatcaaattgtacactttaaataagtgaaatctattgtatatcaattatactacaataaagctgttaataaaggtacattaaacaaaaatattacttcattacagaaattatgccatatatctctttgttgtcctttgcagactactggcagtagttggtctttgcacaactactgaaaaacaaaggaaactacgtaacatttttctgcaaagaaatttctccctacaccagaattccattctggcaaactcagtttgaaggagtggccaccactctaggccacagcaagaaatcatgagtgagttccttaataggtaccaggcatcttcttccagcactgtattttttaaaattatactttgaattctgggatacatgtgcagaaagtggaggttttttacatgtgccatggtggtttgctgcacccatcaacccatcatctacattagctatttctcctaatgttatccctcccctagcccgacaggccccggtgtgtgatgttcccctccctgtgtccatgcatcctcattgttcaactctcacttatgaatgagaacatatggtgtttggttttctgtttgtgttagtttgctgagaatgatggtttccagcttcatccaggtccctgtaaaggacatgaactcatccttttttatggctgcatggtattccatggtgtatatgtgccacattttctttatccagtctatcatcgatgggcatctgggttggttccaagtccttgctattgtgaatagtgctgcaataaacatacaagtgcatgtgtctttatggaagaatgacttataatcctttgggtatatacccagtaatgcgattgttgggtcaaatggtatttctagttctagatccttgaggaattgccaccatcttccacaatggttgaactaatttatactcccatcaacagtgtaaaagcattcctatttctccaaatcctctccagcatctgttgtttcctgactttttaatgatcgccattctaactggtgtgagatggtatctcactgtggttttgatttgcatttctctagtgaccagtaatgatgagctttttttcatgtttaacggccacgtcttcttttgcgaagtgtgtgttcatatcctttgcccacttttcgatgtttttttttttttcttgtaaacttgtttaagttccttgtagagtctggatattagccctttgtcagatgagtagattgcaaaaactttgtcccactctgtaggttgcctgttcactctgatgatagtttcttttgctgtgcacaagcggtttagtttaattagatcccgtttgtcaattttggccattgcctttggtgttctagtcatgaagtccttgcccatgcctatgtcctgaatggtattgcctaggtttttgtctaggatttttatggttttagttcttacgtttaagtctttaatccatctttagttaatttttgtataaggtgtaagtaaggggtccagttactgttttctggatatggctagccagttttcccaattgcttggattttgttaggtttgtcaaagatcagatggttgtagatgtatggtgttatttctgaggcctctgttctgttccattggtctatgtatatctgtgtttgtaccagtaccatgctgtttttgttactgtaaccttgtagtaaagtttgaagttgggtagcatgatgcctccagctttgttctttttgcttaggactgtcttggctatacagggtcttttttgattccatatgaaatttaaagtcgttttttctaattctatgaagaaagtcaatggtagcttgatcgggatagcattgaatttataaattactttgggcagtatggccatttttgtgataccatgagtatggaatgtttttccatttattgtgtcctctcatttccttgaggagtggtttatagttctccttgaagaggtccttccaatctcttctaagttttattcctgagtattttattctctttatagtcattgtgaatgggagttcactcatgacttggttgtttgtctattattggtgtataggaatacttgtgatttttgcaattgattgtgtatcctgagactttactcaagttgcttatcagcttaaggagattttgggctgagactatggggttttctaaatatacaatcatgtcatctgcaaacagagacaatttgacttcctctcttcctaattgaataccctttatttctttcttttgcctgattgccctgaccagaacttccaatactatgctgaataggagtggtgagagagggcatccttttcttgtgccagttttcaaagggaatgcttccagcttttgtccattcagtacgatgttgcctgtgggtttgtcttaaatagctctaattgagatatggtccatcaatacctagtttattggatttttagcatgaaggggtattgaattttattgaaggacttttctgtatctgctgagataatcatgtggtttttgtcattggttccgtttgtgatatattacatttattgatctgcatatgttgaaccagccttgcatagcagggataaagccgactggattgtggtggataagattttttttttccttacagacagaggttttattgtgtttggtccacagtcatatttcacattatctcatggagcagggcccctgggtggggggtccctgtgcagtacttggaggggcatgtggccgggggagatggagcagtatagctggtcaggcccagaaggggagaagggctggggctccttaagacctactaaggggccgggcacggtggctcacgcctgtaatctcagcacttagggaggccaaggtgcgtggattacctgaggccaggagtttgagaccagcctggctaacatggtgaaacctcgtctctactaaaaatacaaaagtagccaagcatggtggcacatgtctgtaatcccagatacttggggggctgaggcaggagaatcccttgagctcaggaggtggaggtgcagtgagccaagatcatgccactgcactccagactgggcaacaactactaagaaaaaaaccctactgaggccacggtggtggtgtggggagttggggggattaggcccaaccactcagcatccacttccttgtacaggcctcactttccccactgggccctgaggcaggtctgaggtctgttggcctgagggtcctagggaaatccagccacttgggagcctgagatatttagcatcatagacaggccccctttcccaggggactcatttcccagcaccctctccactgtccccaccccattcctcaggaaaaaaaaatgtatttttcttttgttaatgcatcctgaaacttttgcgggtatagaaaccacaaactgatcggctgacaaaagtgggaagaggcaaggcaactggaaacctccgggtactggttccctccaagcccaggtctcttctccccggcacagctctgctggcagcctggacgtgccagcagggaccctcaccatacacatattgggatatggccttgaccccttctcctccacagcctggtggctcattcctgcgaaggaccaaggcaagggggaagaaagccctgctgcctgattccacgttgccactcacagaccctcggttgattggcagcactgaacaggttaagaaaaaaaagatgaaaacacagaaaaacccaaaaacccagaaagggagataatgtggggagagagtgtgctgggagcctcagtagccagcctcctcctggtagtaagggggatattcagggacctctcctgggcccaggcagttgccagcacccaagggagccccgtcagccactgtgcctggcaggcagtacttggggtcacatatatgctggcccaggccaaagacctggctactatggttggtaccctgggtgtagcccatctgcagggacatggaggaattaccacacttgtcggttcccagcttggtgtcacagatgtgctgccgcgtcccaggagctgtcatgctcacctggctggcacagttatttgtacccatctggaggccaatgatcgagtggtccatgggggggcaggatgtgattcttggggtcacacagatgcctcttcacgccatacacggtcatgcccaactggctggtacatttgttggtgcccatttgcagcccgatgacgcactggccagccttcatggcggcgtcactgaagttctgctcctgcttctctgagtatttgatgccaatgtccaccccgctctgcggcctcttagtcttgaccttccctgctagggcaaaaagagacacctgcatgtgcctcatgttcccactctcaaacaggttgttggccttgaacaggtccatggggttcatgtcatagctgactacagccttgatgaagttggagaggttttccagctggtgccacttctgcatggagtggttgatcttggggaatgaggccggctgcagcttgttcatgagtatgcataagataatcccgtccttcaggctcttctggaagtcaggctcaatggagatgcaggtgagtcccttgatccagctgtgaagctctgcctccttctgggggtcatatttgggcaggagccagttcttgacctcggctgacagcccatactagacgcctttgttgaactgcgtggaactcatggctggcaggctgcgggatggggccacacgggacaggggtggataagctttttgatgtgctgctggattgttcatcagggatattggcctgaaattttctgtttttgttgtgtctctgccaggttttggtatcaggatgatgctggcctcataaaatgagttagggaggagtccctctttttctattgtttggaattgtttcagaaggaatggtaccacctcttctttgtacctctgatagaattcagctgtgaatccgtctggtcctgggcttttctttttggtgggtaggctattaattattgcctcaatttcagagcctattgttggtctgttcagggattcaacttcttcctggtttagtcttacagtattctctgatggtagtttgtatttctgtgggatccgtggtgataacccctttatcgtttcttattgtgtctatttgattcttttctctttttctctttattagtctggctagtggtctatcttgtttatcttttcaaaaaaccagctcctgggttcctgcactgtattctaaatctagtacactattttaccaaaaaagaaaaaggattcatcatcattttatccaagcaagcacgaaggcagtcttccaagaagtgaaatagaagagcaaacacacacacacacacacacacacacacacacacacacagacacacacaaacactgactggtagccaaaaatatttgtaaaatatttacaaaagctacaaaataaacgaaaggagagtaaagctgccagaggagagcagaatgtagttattgacaaatatattatttgcaaatggaagtttcagattcacctaatagttactgaattcttactatatgccaagcaatatgcttggaactttcaaatacattatttcaatcttcaaatgagcctgtaaggagtgattcataggccttactaatggaagaagacatgaaataacagactaaacaattcgccaaaagtcacacagcaggaaagctggaatttgatccatgatttgtggatcaaatccagtgcctcatctattataccacacttccccaagcattaattgtcccataaacttcattttaaaaataaatagaaaacaatgacagttaatatttactgacactttactaagaattagatccagtgctaaacactctagatatactagcttttcttagtccattcagtttagctataatgtcccagactggatacctaatagagaaaggaaattcatttcttacagttcgagaggctgggaagtccaaggttgagagacccacatgtggtgaacgacttcctgtggtgtcatcccatggtgaaagatggaagagcaagagacgacaagacagcacgagattcaatgtgcaatctcaagcccttttataatggcattaatctattaatgtgggttaacagattagtacccacctgaacacccctcactagtgcccatctctcaacactattgcattgtagattaaataacaaacacactctttctggggaacacattcaaatcatctttcatcctcacaatccatgaggtaggtacaatcatctctaatctacagctgggatatctgaggcctggaaagattaaataataacatgtaatgtgaatgaatccactcaagtataatagatgtttaagttgtctagttttctgatatgactgacatatttaatcttgattcctttagtatgatttgaagactatgttcaaaacttactgaaaaagtgatgatttcctttagttggtttagagagacgcaaactatagagttgtgatatactattctgtcaaactttcattttaagaaagcactgaggagtactttgttttcttttaagagactctaagtaaaggatgaagagaaattaactcaggctgaactacattaatgctgtaaaaatcctaaagtaacgttaaactttatgggttggtctttgttgataattagcttaatcagattgatcatttactgttcagcttgggaattatctttgcttatgacaagccatctgcatagttttgtagatggacattacttgccctcaatgtggttaagaataatataatctgaagtgtaaaaagatgattcatgggaaatcactgttgaggaaagcctagtattttctccagcttttacacactttggtaccccctgactattaactactctcactagaacactgaggctacatgtttagcagtcactgagcatgtcatgttcagtgttggctcacctaccaagagttaacgaccctaggaaatcagacacacactacccttctcaacatgtcccatctggtatgatttaggttcttagggatgtgttgtttgtttttattttcccatctctataaggtttttcacatcctattaaagagacttctaaggatagacactgaattcaaaaaaaatctgcagctctggtgtttaaatgactgttaaaagtacaactgcaggaatgacaacaaaactgcattcgctattgaaaggaaacagtgaaacctaatatcccatcctaccttccagcaaaatatgtatcgagcttttacaaagtgctgattctttaatatctggcataggaaatgatgttgagaataaatgataccactatttgttgattatctgccaatatcaaataacacattgtgagtccctgaggactcacgagggtcctcacagctagcattcctttcctcgaatttctttttgtattttggttcccataaaactacagttccattttctccaaagagattaatgttaagagaaaaggaagacagccttaaattcttgccagttgtgactattaacaactgtggaattaagatggagaattatctttttcttaaaatacttttatctttgaataaagtagcttttcattcaaatgtaaatatcttcaactgatgacacttctcctagatacagatacatttgaaaattatattaaatgacagaactttagttttgtccttgatcttatcatcttgaaaatcatgacatttttaggtaatgatgcagagaattctcttctctccatgctcccataacacaccacactctaatagttacatattcacagattatctcttgggctagactgaatcacataaaacaccacctttgcctctccaagatctataagtgcttgataaatgtttgtggaattgactggaaacaacttaagttttaaattttcatgtcctatatcagacagtgtcaaatggaaaccctgtattgtaacaaatggaatttaaagaggctaaagatgcaattttgaagtgaattttaggaaaaaacggagttacaatgtgtctatgacctaagcatgctgcactgagaaattatccttcctaagtacctccattaatatgtcattccgaattttaatggctctcccctatgggagggtgtatagtcccttagcctgggaggcagtgtaccactgtaatatggaatataggccctgggtgtgactctcagccctacaactaactagcatgtaaccctgggcaggtaatgtaacccctcttagccacactttgctcaatgctgtagggttgctgtaataatgtattcaaagcatttagcaggtacttgacacaaagtaagtgctaaatcaatgttggctattaatatccaaaatgtaaagcctttaatactttgtaaaattaattgatttttcacagcttgagatataactcatataccataaaatccactcttttgatgtgtacaattcagtggattttagtatattaacagagttgtgcatccatcacaaccattacttctatctgaggacataaataccccaaaaagatacttcatattccatcagcagtcactttccattctcccagtcctttgcaaccactaatcaactttctgtttatagatttgcctattctggatatttcatacagtcacatgatacagtcttttgtaactggattctttcatttggtatagtgttttcaaggctcattcaggctgcagcatgtataaatacctcactcctttttatgggtgaacagtattccattgtatggatagaccactttttgttaatccgcttatcatttaatggacatttgagttgtttccactttttggcaattaggaataatactgctgtgaacatttttgtacatgtttctgtgtggtattagattttgtcacgtttcttctgtgatgatcacctggtttttgtcctttattccattactatggagtattacattgatttttttacatatataaaaccaatcttgcattcctgggataaatcccacttggtcatggtatataatcatttttatatatttctggattttgtttgctactattttgtcgaggatttttccatctatactcataagatgttggtatatagttttcttgtgatatctttgtctgtggtatcttctacatgttggccacaattttttgacccagaattatttccaatgccttgatgtgcatattatttcccagttcatctgactcccaacgtttctccccagtcccttcccaattccgttattccactaagactttgtgttctcctgcttcgagttgttgactaacactgccctttcttcccaattcactctacttatctatatcctacagaccctcaaatccctctttctcttgaaaccttgatagaccacccaacccctagagctctctcccttcttgagatgctgatgtcatattacaaactaacatttgcttactgcttaaaatttcccaaactcatattgcatttaattcccatgaccctgagaaacaggtatgtatgctattattaaaccaattttgtacaaaaccaagtggctggtccataattatatagctatgaagtaaaaaatagtaaaccctatgcttatggtggcattttaaagcaggggagggttctactgatacctcaccttctagctctgagattaagtttttatttaccaaattcagtctttcctccttcatgtagcaacaaatatttactatgtatgtttactatacataagatactatttgaggtactgagaaggcctaagggatagactccaaagagaatgtcctccccacaaatcttcatatatgaccagaaactgccatcttttgaaagtaaaacttataaaaatcaagactaaactgataagcaaatcagctcaaagatgaaaaaggagttacttatgagagtaaagtactgcttaaatattcaatattaattaattaaatcaagggcttttccaaatccagtatgtccttatggttgtattcctaatactttggtttgaccaactgaagtaaataaaatagtaacctcattaactgtaaaggtgatctgcatgaaacctaaagaaaatcaaacaatatcaaaattaatcaaaaggtgccagagagacttctgcttctaattgtaatggagtaaccgacactggacttgttttaccattataaacaactagaaaagtatatgaaattgttttattcaaacattggatatcaggcagtatgggactatgaatctagagaaaaggaaatccttttgtgcctaaactttctagattgcagtatggtatgaggagaccaaagcagaatatgatggtctgaattctgaccagacagataagaaagatcttgttgaacactggggacattcaacagaaacctcagaaggatttcagcttattaataagaataaactagtcttaacaaagcttaaaggtaagttccaaaagagacaagctgaacctcaagtaacttaactaccttttaggaaaaaaaaagtttgacattctttaaagaaaaacaacaaaatctctaagttcagcaatataatggtcacaatgtccagtatcctttcaaaattaacagaaaagccaaaaaaaaaaaaaaaaaaaaaaggacccataaacaggaaaaactccagtcaaattcagagacgacagagaagttaaaagtaacagacaaggatttcattattatattattattattattagatggagtctcactcccgtcgcccaggctggagtgcggtggtgtgatcttggctcactgcaacctctgcctcctgggttcaaggaattctcctgcctcaacctcctgagtagctgagactacaggtgtgcaacaccacgcctggctagagatagagtttcactatgttggccgggttggtctcggattcctgacctcaggtgatccacctgcctcagcctcccagagtactaggattccaggtgtgggccaccacgcccggccacagacaaggattgtaaaatagatgtctacacaaatttaaaggaataaaggggtgtagcgaggaagaaaatataagatatttaaaaaatcatggaatttctagaacttaacaaaatctctgaagcagattaagcattacagaagaatatacgaacgtcaaagatgacaatgaaagttacctagccggaagcacaaaggaaaaaaatgctggaaataaaagagtcccagtgacccatgggataatgacaaatgacctaacatatctgtaaacagaaggcggaagtagaaagcaaaaaaaaaagatttgaaaaaataatggtcaaaatgtttcccagtttgatgaaaactataaactcacagatatacagaaattttaacgaaccaacaaaatacacaaaagtacatcacaatcaaattgctgaaaactgacaaaaagaaactctctcaaaagcagtctgggggaaaagaaacattacttaccgtaaaataaagataacaatgattgctgtatctcatcagaaacagtaaagtcagaaacatgccagaatgatatctttgaagtcttgaaagtaaaataaaacacaaactgtcacattagaattttatatccagaaaaaaaagttagttattaaaaagtgaagacaggccgggtacagtggctcatgcctgtaatcccagcactttgggaggccgaggcgggcggatcacgaggtcacgagatccagaccatcctggctaacatggtggaaccccgtctctgctaaaaataaatacaaaaaaattaaccaggcatggtagcgggtgcctgtagtcccagctactcggaaggctgaggcaggagaatggcgcaaacctgggaggcagagcttgcagtgagcctgagcaactactgcactccagcctgagcgacagtgaggctgacccctcaaaaaaaaaaaaaaaaaaaggtgaagacaaaatgaagccattttttagacaaacaaaagctgagagaagtcatcactagtagacctacgctacaagaaacgttaaagatcgttacagataaggaaaattatgccagaaggaaatgggcctacaacacaaacaaggaaggaggccaggaatagcaagtatgtgagtaaacagacaataattttgtattcttattcaaaaaacaaattttaaaacaaaaacagcagcaatgtattgtggggcatataacctatgtctaagtaaattatagggcaacaataacacaaaggatgagattggaacaatgctgctgtatggttaccacactgtatatgaagtaacataaagtatttaatggtagactgtgattgaggtgcatattgtacacactaaagcaaacactttaaaaagaggtacagctaataatgcaaaatagaataaaaagagtggtaaaattatctaactcaaccaaaagaaggcagacaaagagggaaaatatggacaaagagaaaacaaatcaaaatgggggattttagacccgaccatatcattaatacattgaatgttgaacaacaaaaatgaaaacacgaagagtagatattattccatttatatgaaattctagaataggcaaaaataattaaaaagaatcagtggttgccagaagccaagggtgttacctgcaaagaggcatgagaaatctttctaaggcatggaaacaatctacatcttgattcggatggttacacaggtgtatatacatggtacttaaatgggtgcattttattgtatgtaaattatacttcagtaaagtcatttaaaacgttaaaagatcttcagtggcaaaacagatttgaacccaagctgccttgcaataagcacttatggttttatggactcactatgtggcttcttgtctggcctgaaagaggagattccatttattcaatttaacttccactacctgatattgttatgtgccgggcgcagtggctcacacctgtaatcccagcattttgggaggctgaggctggtggatcatgaggtcaggagttcaagaccagcctagccaacatggtgaaaccccatctctacttaagataaaaaaaattagccaggcatggtggtgcgtgcctgtagtcccagctacgaatcacttgaacccgggaggcagcggtttcagggagccgagatcacgccattgcgctccagcctgggtgacagggcaagactccatctcaaaaatgttactcgtttttagactgaaatatcttggaagaaaacattaaatgctagaagttaatttatcaagaaattcctaacacctatatgatgacatcagtgatgaacattacaacaaataattgaagggatttttatcatattatatcatattcctagatgaggagtcaatatggtaaagatagcatttttcctcattttaatatggacatgtaatgttatgccaatcaaaattccaatcaaagttttttagagtaacataaggtacttagaaaatcggtttgaaatttcttctaaaagaataaatgggctttgaaaaaccaaataagagggtatgttgcctatattatagtaacacatcttataaaacctagtaattaaggcagtctggtactagtgaaagaacagaaaaaattatgagctctaaaacagaaatttcctgtatagtttggtgcaaaagtcattgcagtttttgccattaatcaaattacttttgctccaacctgtatatatggaaatgcatcatgtaatgttatattcaggcatcatgtaatgttatattcagatgagttgcaaaggggtagactgtttaataaattgttttgaagtaactaaacattcatttataaacaaacaaccctcacctttcattatacatgaaaataaattccaaccagattaaagatttaaacaacaaaaccataaaagtactgaaagaaaatattaagggccgtttgtataatcttaaaggggtttgttcaaaaatgacaggacggagcttgcagtgagccgagattgcgtcactgcagtccgcagtccagcctgggcgacagagcgagactccgtctcaaaaaaaaaaaaaaaaaaaaaatgacaggaaatccagaagctgtcagaaaaagactaaaggagaagactacatgagaatttaaaatctgcacatggcaaacaactgttttaaaaaaattaaaaagcaaagaacaaacatattttcaaattctacaacaaacaaaagattaacatacctaacctcttataaatgaaaccaatactctaaggccttcttggtaagcaagttgtaaatatgtttttattttgcaattccacttctagaaccatatccaactgagcatctaatatgtacacatatacgtgtgtgtatacgtatatacatatgtgtatacagttacagatttacaagtaaaatttttcttgggtctccaaaggtttttatttcagcagtctgtttaataggaaaaattagtggaaaaaccaccctcaagtgtacattaatacaggattaaatgatgatatactgatgcaagagtattctatgcagctgttaaaaataaatgccggagatgtaggtactaacatgacaaggtgttatctcttgtttgacatattatgctgtcatttttaatttaaaaagttacacaataggccggacaccgtggctcatgcctgtaatcctagcactttgggaggccaaggcaggtgaattacctgaggacaggagttcgagaccagcttggccaacatggcaaaacccccgtctctactaaaaatacgaaaattagccgggcatggtggtaggtgcctataatcccagctacttgggaggctgaggcaggagaatcgcttgaacctggggggcggaggttgctgtgagacaagattgtgccacttcaatccagcctgggcaaaagagtgaaactccatctcaaaaaaaaaaaaaaaaaaattacacaatagaagcctcttgactgactcaatcaggaccattggttggtcaacagaaaaaggttaaagcagaaaaagatactttaaatatttcatttctccagtcttttgatatagaaccaagaactttacttaatcatgggtccacctgtctcttctgattaaatcacacccctaaattattatttatgatttctggtttcaatttccttaaagtgaagtaaggacttaagaacatttgcaaagcaattccaggtgcccattctatctaggtttatatttttccccagtcttttacagttgtcttaaattgattgcatctttagtttttcttagcatctagcctttagcaaatattttcaaagcattaaacttcagaataattaataattccctttcatactcacattttggtttaaatatttcattaaactgcaaaattacaataacaaatacaactagaataaaatatttggaaacaaacaaggttaactcgacaaacacaaaactcagtaatctaactgaattaatattcaagtttattaataaatcttttattaaatttactactgtgagtcagtttaaccaagtataattaactctgtatcaactgataaaatgtttctagatctgtgctgtccaatacggtagcacgcatggcaatggagaacgtgaaatgtggctagtctgaagagatgtgctgtcaatgtaaaacacataccatatttcaaagaatgcatatgaaaaagaatgcaaaatattgtattaataacttatagtgattatatgttgcaatattttgaaaatactggattaaagttattaacattaatttcacgtattttttaatgtggctactagcttattttaaatgacaaatgttgctctcattctattagatagcactgttctagacctgcggacatcctttgttcaatgatgatatcatctgtgaggttctacttgaaacaatgaatcagactttcctatcatctgttacctggatcagagatatttgagtaacatttataaatcttcttaagctgacttgtgactctgtaacagggatctgtaaactatggcccatgggtcaaatataccctgctgttttggtatggcctacaagctaaaaccagtttttgcatgtttaaatgtctagaaacaataaaaagattagcatttgtaatccatacaaattatgtaaaaattccaatttccatgtctataaataaactttaattggcacatagccacactcaatattatctatgactgtttggtgatactatggcatggctgagtagttgcaacagagaccacgttgcctccaaaatttacatttactatctagccctatacagaaaaaaaatgtgctgagccctgctctatatcatctcttaaggttcatggggtatagtgagttgccaattgcacctaccggacctgtccaaacaatgagaagggaaagcttgtgtctccattcttatccttaccagagactagtttagatttccagcttcttaacttgcttctgccgctattcaacaaagtgtctagaaccccaccttctgggatagttcttacacagatggtatcacaaaaatgctcagatatctgtggggtcaaatggtccctgtgtgcctttgctttcacatccaccagtgttctatgacaccaatgttatcctttgtgggcttgggtactcactgcccttttggtgtctagcctatgggtactagttttattgtttttgtaacccctcaactcatttgcaagactgttcctcaagccctggtttttcagatacctacctcagtagaccctgtgaatgcaatcttgtctatgccaatgtgagaagctattgctgccccagccgttggcccatatcctggcaaaatattgatgaccccgggaggaaagccagcctaagaaaacagaacaggaggaaacgtggctgatgaaagctgatgcatcatgttaaatgagatatgctctagtaggctccagctgtaaggggagtcagaagcactcccgaagtccgtttctcttacctccttgatgagggctcccatgtagagtgcactgagtggtgtttgctctgctggcttaataactactgtattgccacagcacaaagctggagctattttccaggcaaacatcagcagggggaagttccactgaaaggaaaaaactcaaagttgatagatggaaaaacattcttccactactttgttttcaagctgtgacttctcatatttctcaaactagtcctcgacataaatcttgtccactacaaagtacagatgtttggattttcaattacttcattaagaatagaatagcactgaccttggaaatctctccttttctctctgaccaaccaattactatactccaactacccaccaaaagaaatcccactgtgaaaagggagttttgttacttctttgttttgttttgtcactgtttttatgttttttttaattaggctttggttccaataagttctcgtgtatgaaaacttttcttgcatctgagatttttacatcacaattttcacactggtatgaaagctcttcaacatggaaaaactagaaaattctaactgagttgtagttaagtcaatgtgtatttcaaggtagtactttttctttagatacatgcattgtcacaaacatatatgattacaaaaaataaactgcatatactgatgagtatgcaaaaattttcatttgtctcttttccactgtaaaagaagctattggagactacagtaacatttacatgagtagatgaggttggggtctaaaatggtttaaactgattttaaaaagatattaagcttgtattgtcataagctcaggcatgagcctcagtactatcaggtgtcattgataatttcattaagaaagaaaacagaaatcctcatcccctggcttcagcccttgaccacaatgtgtttctgcctgaagcatctcagctgccatccttcaaggcttctcactggctctggcaagcttgcaaaaatatacaagtgtcttgccttcaccaaacacccaatttcttttccccttagttgtttataaacttgggagtccaccgtaatgttttaattccatctacagtgtataaatcttaaagtgcagtaattgagccagagctggctgacaagcagctcttgtcctgtcagtgaagctgcagcgttgagagtctgggcaagggcaagaaaagtaagtttgaatcctacgaggaaggtgacagacctcatcccagagctggtccaagtaggatttccccagggcctttaagagcaagagaacttaaatcaaacctctcattttcccttggcattctctaataaatttcacagtaacctgggattcatcaattattcaaataaatattatatcttccccacatctttggttcccaatgccaaagattatcttgagttatactactgtactttgaaaaaagaaaacttcttgtctatactgtaagagtttactttgagcatccccttgaaatccctgccagaactattagctagtactgttaaaagctatggtcatgttttgtattgtaccaagggtgtgtatgagagacagacaggaacaaagggacaatgtttaatgttccaatccaaacactaagcactacatctatttctctttacaagacacataacagctcggcatggtttcaattatgactgtgacgttaactgtagtgctgtgtcttctgtagcatcttctatctagattcttgagaaaagaaacagtgggaaagaatgggattaaaagatcatataaaataatatgcctggaaggatggtgagtcacagttctaaaaaataaacaactataacaaagcattaattttccataagcagaatggacataataaccaagggcaggttattaatacactgtgctttgcttattttaatcatgagaattccatgacttgagaattcaactcctggtaacagagctgaaaccctattaacctgttcaaataagcatttgcagggaggctgttaaagatatgtcaacaacatgagctcagttttttttcctccagtaatggaaaacacacatcgctgaggaccatgttttatgtgtctttaagagaactgggtcaaatgaaaataaatacgaggtgcgaggaaatacactcactgggatgatctgtccacacactccaatgggttcatgtcttgtaaaggtaaaatagtctccatctgaaagaaaaaagcatggtcactcccagaaagtttagattaggaaaaaaaatgcaaagggagaactttggtggctgcaaaaaaaaaaaaaaaaaaacaaacagaaataaacttgaaaaaacatcctactcaaccgtgcatgaaagctggtagaagcctaacactggacatagcatatttctggatatatctctcagacacccaaatgcagtattgaggaaaggatctctaaggcaaaatgaatgacaaatttatgatacaagaagtcctcagggtggcagaggggacagctgaaaaatatgtaaaaattgaattttatgttaaatattaaaataacatgtagaacagttgtttgatttaaaaactgagtcaacaaacctttaaataactttctgaagtattaaaataaactaagtaaaatgctattgggcaaatttaaaatgctcggcaactggaaaaagtgaggagtaaaagatatatttcataactcaatccaggtgtcaaaatgtacttcctgggtagtgatgagacataggcatgtccagggctatttaaagaaggtaaaagtccatttctaaaaagaactccatcaataatccaaagcgtctgcccccaaactagacatagaaatgagaatgtcctaggggctaaaagaaaaagagcttcagaaaaacttaataaccttgttttccttacaggagtaataggcaactgaaataattatacaggaagtccaaaccaaattcatctttaggaaaatgtcattgcttttatctgaattattttaaatggttaattaaaattaccaaagaatggctcatttttagcagatagcttttcattttaaatactgggcaaagtctttatttttccctccactgccggcccttaggccacttcactgatacttgttttctctctcaaaagcagtcccctaaggcaagtgaaaacactcagctaatattcatgaaagcataactattataggtggaaatgaaggtggggacaggaggactgtgtgggtcgggaaaagagaagcgatatgaatcagattgtttatcactgtctctcaacacacctaaatcacatttatcacacaaaattgttttgacatattcaaaattatttattttttaaataattacattaaagtcttggcctctctctctctctctctctcttactctcccagtgtcactctctatcctctggatctctgatctctaccccctcttgccataattatctgtttcctcttttcaaggaacttttattcacatacaagtatttataggatccttttatcctctttttttttatacaaacgggatattattcagtcttttatattttgtttttccctcttttttttttttttcctgtaaagctaggacgtctttttagtggctgcaggttattccatgggctcaataaacaatgttactactgtaaaccctcctactaagggacatagaagtcactttcagtttaggctattataaataatgctgcaaagactatcattacaaacatatcttttcatatctgtggaatttcttgatctaagtgtatgtacatttcagattttcaaaaatattgccaaatcacccttcagaaaagtttaacaattcataatttcaacaacacgctatttttcctactctttaacactgaggtttttccaacattttcatttcagctaatctgatagctggaaaactgcaacttgttttgatttatgtttaatgatagagtgaacatcttttcatgcttatattgtttgctatttttctattgggttattctttttagccatttgaagagctctatggatattaaggaaattaggcctctgtcataatattgcaaagatttttccccaatctgctacttatctcttgactttgttttatgtatattttaaatggaagaaattcagaagtaggctggattctgcaactgtatgaaattaatttaaaatatctattacgagaaaaaatagcgaagatgttgcaactgtccataggatgacagtatgaagtctgagtaatactttaaacatcaaattaactatttagctttgtatgcagataactaaagaatcttctggatatcattctttacaagactacaaattaccatgcttcttcaatttgtaaatctctgaaaaggtttttcatgaggagcaacaccactgatcaataagctagagtttcatttacaagaaaatcttctgcaactgaactctctaagttggttaaggtgatgggttcaggtggatagtcacagaccacagaatcagagagtaatgtcaagaaagagtgcaaatggggctgaggaaaaaaattggaagatgaacagaagagtacacgtgtttattttagcagcacatgtaggaacctggaatggttcagaaaaaaaaactcacaaggcaactacacaagcactgcatggcaattcataaaccatttccccctacacattttatgatgcttagacatttagttgttttacttaaataatatcacaagttaccgaaaaaagtgaaagggaagaaaatgtagacaaaaatcttaaaagtcggacctcatgaggaattgagtttgactccataattgtgtctcaagagaaactgagttatgaggaattaaaactctcttggataaaccgttcacatatttgaaaagcatttagctacaggctaacacagggaaagagacagaatcttctagtccctacagttagtctaagtagcaaattaaaaaataaacgctatttttgtgcttgaactcttcccaaaagagcactgagttgaagggacaaagaaaggaggctactttcaataaaattcaacattccttcaggttaaaaactctcaataaagtagaggcattgatggaacatacctcaaaataattaagagtcatttatggcaaactcacagccaatatcatactgaacaggcaaaagatggaagcattccccttgaaaactagcacaagacaaggatgccctctttcaccactcctattcaacatagtattggaagttctggccagttctttctcaggcaagagaaagaaataaagggcattcaaataggaagagagaaagtaaaactgtctctttttgcagatgacatggtcctatatctagaaaaccccattgtctcagcacaaaagcttcttaagctgataagcaacttcaactaagtctcaggatacagaatcaatgtgcaaaaatcacaaccattcctatacaccaacaatagacaagcagagagctaaatcatgaataaactcccattcataattgatacaaacagaataaagtacctaagaaatacagctaataaaggaagtgaaggacctcttcaaggagaactaaaaaccactaatcagggaaatcagagaggatacaaacaaatggaaaaacattccatgctcatggataggaagaatcaataccatgaaaatggctataatgcccaaagtaatttaaaaattcaatgctattgtcattaaactaccactgacattcttcacagaattagaaaaaataactttaaatttcatatggaacctaaagagcccatatagccaagacaatcctaagcaaaaagaacaaagctggaggcatcatgctacctgacttcaaactatactacaaggctacagtaaccaaaacaacatggtactggtacaaaaacagacacacagaccaatggaacagaatagagaaatcagagataagaccacacatctacaaccatctgatcttcgacaaacctgacaaaaacaaacaatggggaaaggattccccatataataaatggtgctgggaaaactagctagcaatatgcagaaaattaaaactggaccccttctttacatcttatacaaaaattacctcaagatgaattaaagacttaagtgcaaaacccaaaactatgaaaactctacaagaaaatctaggcaataccattcaggacatgggcataggcaagattgcatgatgaaaacgtcaaaagcaatcgcaacaaaagcaaaaattgacaatttggatctaattaaacaaaagagcttctgcacagcaaaaggaactatcagagtgaacagcctacagaatgggagaaattttttgcaatctatgcatctgacaaaggtctactatccagaatctacaaggaatttaaacaaatttagaagaaaaaaataaccccattaaaaagtgggcaaaaggacatgaacagacacttctcaaaagaagacagtcacgcagccaaaaaacatgaaaaaaagctcatcatcaatgatcattagagaaatgcaatctaaaccacaatgagaaaccatctcaccccactcagaagggcaattattaaaaagtcaagaaacaacagatgctggcaaaggtgtggaaaaataggaacactgttcctatttcccactttgtttacattcccactgttggtgggaatgtaaattagttcaaccattgtggaagacagtgtggcaattcctcaaagaccgagaaccagaaataccattttacccagcagtcccattactgagtatatacccaaaggaatataaatcattctgttataaagatacatgcatgtgtatgttcattgcagcactattcacaatagcaaagacgtggaatcaacccaaatccccatcaatgatagactggataaagagaatgtggtatatatacatcaaggaatactatgcagccataaaaaggaatgggatcatgacctttgcagggacaatagatggagctggaagccattaacacaggaactaacacaggaacagaaaaccgaacatcacatattttcatgtattgggggagctgaacacacatggacacaggaaggggaacaacagacattggcacctttctggggaggggtgggggaaggcagaatatcaagataaatagctaatgcatgctgggcttaatacctaggtgatgggttgacaggtgcagcaaaccaccatggcacacgtttacctgtgtaacaaacctgcacaggtaatccagaactaaaataaaataaagggccctagaccttgtaatctcactttgcattttcacgtggatggtgaaaggtgacacccctagtctgatctggggtgcctgacaaacacaagagctaagccttctgtgggcaccttcagctagggctaacagcaccccagaagtcattcacagctactaagaccctactatgaattccactgaacttctaaatcagggttaccgtaagaccagttataaaagccatcttcataatttttgccatttccaagtatcatttgctctgtcatttacttaatttctgttaaattaactcacctgttagaaatatgtaaatagctacctgttagccttaaggaaaatctaaaatctaaaataacaggtttcatgggctggtaatattttcttctaatattcttcaaaccaaggaattaaaattaaaaaagtttacttgcttactgtatagaatcatcttgaatgctaccagtgctacacgggatgctatatggtgattctcaaacttgaatgtacacactaagcaactggagatctcgtgaatatacagattctgaatcaacaggtctaggatgggaccagagagtctgcatttctacatgctctcagctgaggctcatgcttctgatccacagaccacactctgagtagcaagatcaggagtgtaaaggggagtccacgtgtattatgatgccctatggttgcttcacagttgtctgccttcatttttatttattttttgtctctctaataactctactaattttcctgaaaggagtatatagtgtaggagaatctgatctgtatttttaatacttcaaaattgttaaaaaaaaaaaaaaaaaaagaatgaaaacactattagaatttctgtagagccttataattttcacatccttatctcattttacactcaaaactctctgaaaaaaatagagcaactatcattatcagcatcttataaacagagaaaatatggcacagagaggttaagtccaaagtggcaccactggttgaggctcctggacttggatctgggtcttcagacttcaagttctttacccataaaaacatattaatgactcttgtgaggaaggtgttggatttaggtggataatcacaaatcacagaattagagtataatgtcaagaacaatcacaaatggggtaaaaataaacaaagaaaaaacctcaatgacaactcttttgtaatatgaacacagaacacatggaaacttgttataaagggaacactacagagaaacattccctggaataggtgagcccaggactaagcgcctctctccctttcatctaggcagagccaactcgaaatggagacagtgttaattctccctctcatctatacctcagatgatacataatgagtactcttctctgcctagaaaaaattaaagccaattttccatcttttatgctaacaatggtctctcagtatggcaggatgacttagaaggttgtttccttcatttctctagctttgtgctgtaagctcaacagcctgatataaaaacagtctccacccaaattcagatactccattgtagggtatgaatggttttggatcttcttagcaaatatgagggattacagagagtgctcagacttagcataaaaaaggactgcatttgatggggacaccagaaaatgttctggataccacattgtaggtcaataggtgagaacacaactatgatggagaaaactaaagaaaagatgagagatcaaaacaaatactaagtcacacgtgtaggacttttgatctctgtctcttttccctttcactcagaaggtaaaacgcagactaacagatattgctcttaaaggggggttattttaagacccagtcagaggtaacttttctgatgagttttgatacctgggtgcttttaatgaccaaatagtagtttacaacttatggaaaatataaaaatcttacaattaaatacttcattatgctatgaatttggctgagctgtgaattaaattttactgagtatgtgtgcattgagccatttctataattatattaagaacagcccttgctgctagagatcaacagtacaataagcctctactatatttgcgaactactgagccactgttctatgttttttgatggggccttatcaaactacacagaagagagagaaatatttaattagaaaaatttaattatttggataattcattcaaggcaaacattacttcttaaatcagatcttacagttgcctgaaagaaactgatggaatttttagtctcataaaaatatctcgcattggcacatcctatatattaatataaactagagtgagtatgactaagcaatctgtaaacagtgataaaatcagaagaatctgaaatgtgccagaaattgagaaatttgtcaaatatggaagtcaaatagcttccaattataacactaagaacactacaagaactgtagcaaattttatatacctagtaacaataaaaacgattttattcaatagcataaaaatctgtaacacaattcagtgaatgaaggtcatcttccaatccctaatttgtagacagaattacctttcaaggagctggcaattctttgatgaccacagtattaaaaaatgagatgattacattgaactattccattatgtatgtactgtagcagattcccatcatgttgacgttgaacagacctcacccaacattttataactatgatgataaactctataaatgcctatacaaacgctgaaactgtatgttagtatgaagtgtactgatgcttttcttcccagaagtctgctggtagtttctaagaagttagattatgttcctgagtctgtcatgaagatagcttagctctacgactattccactacatgatcgtaacaaaagttagtttacttctctggaccttctctgtaaaatcaggagatcagccttagggatccctgaggcccttttcagcttcaacctcttaaaaaggttccttgtgaagctgacttcatgacctcctgtcacaatcaattcaggtcccactaacaagcaagccctggttgttgttaggtgggcagagcaaatcacccctcactcttattctgatggaacaagaatacttcagatttcaccctatgcatttgttaatgacagtaaaccagatcaagctgattcaaggcaaaatcttaggatctgaatcactatctttgtgtatttgtatcctattctttaacaggttaaactggaagagggtgaaatggaaagttatatatgacctgggtagtttttaaccttttctatatgctaacatatcgtaagtccattttaatatcagaattcagcttaaaacatggacatttttttctgcttacataaaatcagtaaaatcaacacttgctacagagaaaaatctaaggcaatacaaattaacttccatttctccctaagtaaatgaaaaccaagcgttgatccttccttcatcacaaagaggttgtagacgtgagagaagaggatttgaatacaggttaaaaatactcaaaatggagaaaacaatacttttctttagggctgctataacattagcgataatgtaacaggtaaaaaagtgttccataggtcatagtaatgattattatttatcatcataattaggcactgccatcgtaaaagggtcaaagcttaggatttatggtcagagacaatggctccattgggtaccatggcaggaaataatggatagtgttgtaaaggaaacaacatcaagactcttgtgaatcaaactagtattgcataattgtgcaataacatccagctgtgggccttgagcgaaacagaatgaagagtggtgggagaaatttccaattcagagagagaagcagccacccactttttcattgctcaaaagtggtcatgagataacccttttgtctccttcccaagtattctagttgaaggctaccctttacggggagaaattaagcaggtatttgctctctctaactgattatccatctgtagtcaaagtgaaatctatcctttatggggagaaataaaacaagtacttgctgtctctaactgattatccatttgtagtcaaagtgctctttctaaaatgcaatttttcaaatagattcaacgggtttatgtgcagatttgttacatggatatattgcataactatgagccttgggcttctagtgcgcccatcaccagaatagtcaacgtggtacccaacaggtagttttcaatcctcagccccctctcactctccctccttttgaaggctcccaatgtgtattaggtctctccgtatgtccatgtttacctaccgcttagctctcacttataagtgaaagcatgtggtattagtttctgtttctgggttatttcacttatttcagtataatggcctccaaccccatccatgttgctgcaaaagaaatgatttcataatttttatggctgtgtagtatcccatgatttgtgtgtgtgcgtgtgtgtgtgtgtgtatatatatacatatatatatatattttatccagtcatccattgaacagcacttaggttcattttatttacaatagcccctccaaaatacctaacaatatttaattaaggaggtgaaagatctctacaagcagaagtacaaaatactaatgaaaaaaatcaccgatgacacaaatggaaaaacaccccatgttcatggattagaagactcaatattgttaaaatgaccatactttccaaagcaatatacagatttgatgcaattcctaaaatgtaattttgatcaaggcactcacctatttaatttggtgactcactattgcctacagaataaaacttgcagcatggctgacccagacttggggctctactgtctttcatatctgcttatacttttagatccactaactcatggtactctcctccctcatactttgtgccagctactcccactgcctgtaatgtccctgactccatgttcacttaacttgtccttcaggttatcacttagacatcccaccaccctctccaggaagccttaatactaggagatgtctctcctatggtgtcccaccaaatttcatgcttccatatctaaatagatcacactatattgcagttgcttcgctacttgtttttcttactgtcctataaacatcttagttatttgcctttgtaacccaatgcctaatacaggagctgaaacatagcagatgctaaaaaaaatctgctgaataaatgaatgtatgaagaaatgggtgaaggaataagagatcaaagttgatgccacagaaaggaggtaaaagaaaatcccttccaattacatgatacctttccctagccttcccaaatgggaatgagtgaaagacataatggcttatttcttcccattctttttggttgtttagtgttagagatgttatgctggatgaaccatggagtataattcaatgttgtaaagcagtcttacatctaaaaatttaacaacaaaaaaccctatttcaggttctttttttatgggtgaccaaacagaactgtgttactatctctgacactcactatgaaagccccctttacccatatgattaggatctaggcagggagatccccacctcaagtgttccagaacatttaagcttcataaatgctatcttgagaaaagtaggctctagatacagtcgattttcattatttgtggattccatatttaaggacttgcctactacctaaaatttatttgtaacccaaaaataagtacagagtgttctcagagtcatttacgggcatgtatatccaaagcagggatttttttttttttatttcaatagttttgggagtacaggtggtgtttggttacatgaataagttctttagcagtggtttccaagattttggtgcatctgtcacctgggtagtgtacactgtacccaatatgtagtcttttatcactcaccccactcccatccttccccaaagtccattataacagtcttacgcctttgcatcctcatagcttagcacttacttagaagtgagaatataagatatttggttttccattcctgagttacttcacttagaataatggcctccagctccattcaagatgttgcaaagaccattatttcattctgttttatgtcagagtagtattccatggtgcatatttaccacaccttctttatccactcgttggctgacgtgcagttaggttggtaccatatttttgcagtttcaaattgtactgctatagacatgcatgtgcatgtgtctttttcatataatgaattattttccctgggtaggtacacccattagtgggattgctggaccaaatggtagtgccacttttagttctttaaggaatctccatactgttttctgtagtgattgtactagtttacattcccaaccagcagtgtgtaaaagtgttccctctcaccacatccacgccaacatctattttttttatttttaaattatggactttttttttttttgcagtagtgaggtggttcagctgtggttttaatttgcatttccccaaagcagggaaaattttgagtcacctgatgcacaaattctcagctggggttgagcaaggtgacactctgccttcttgcttcagctctcatattgttaaaaaaaaaaaaaaaaagtgtccttttttgtggtctgtttagtgccacatttttcatatttttgtgccttttgttcacaattttgctgtttaaaatggcccctaagcatagtgttgagtgctgtctagtgttcctaagtgcaagaatgctgtaatgtgccttacagagaaaatacatgtgtcacacaagcttcattcaggcatcagttatagtacttctgtctggttggccatgagttcagtgttcataaatcaacaatatatattaaacaaagaatctttcaacagaaacacataaatcaaggccattctctgatcagcagacaagaatgttgtgatcagaagctcacaggaacctaatcttttatttcccctaggagcaatagttccatatttgctaattcagtgttcgtgacaactttataaaacataactactatgaatgatgagaataaaccatatattagtataaaaatctgcactggggtaaagacttcatcatattagtataaaaatctgcactggggtaaagacttcatcagggccaccttcctgccttgctgaaccaatctccataagaagagaatttatcatggcttaggcagaacaacacttaagtttgaatctcacgtctcccacttactagccatgtgaccttctacaagacactaaacccttgcagtcttattttcttagatgtaaaatgggtaaaataccatttaaaatccagactatctcatcagatcacacacagaatcacatagatattgtacataaaagaatattttatacttttaaattctatgcaaatataaagtacattatttctttataattcccaacataaaattaggttgttttgtaggaaaatgcatttagcacaataaagatctcatggttaaagactaacggactttctatattccagacttcactgtgaaaaaaaaaaaagccaagtatgcagagacaaaatgaagctgatgttaaattatggagttacaaaagacaaatacaaatggattaatttactgaacaaatttgagaacaagtgaataattatgattacgatacccctttctgtgatcttcccctatgactcccctgatttagtccagctacattcactaagcactagactagctaaagacattgttggctgaattctaagtggcctctaggcaagcccaaatgtatctaaaactggaaaagagaggacagctgccaagttaacctctacctccatccttccctcatctgtttgagacaccatggagagagctcttatgacccaaacttcagcctcctgagaattctgtcaacaggcctgatggcagggagggtacctcatcctagtatgactctaaatgcactttcagaaaaactttttggggaaaaacagttacttagagtttaagagaattcatcgttttttttccttcattgactgaacaacagttaatgagtaaagtggggaaagactactgtgagagccctatgagagccttttctatgccctgtatttataactcgtagataagcatccacaggatctccaaaacgcatcagatgaaaacagtgaggcttatgggccaaccacctctattgccagatcaagttacattaaagcttcaaacattatcagggatgtcaatcaatatttagctttatctaatcaggatcttccctcctgaggaagtaaaagaaaaccaaggtaccgttaggccaaatagagatctatgtgcattgccttctgtttcacaatcttcctcagagctttgtaaatagtttgaaaagatatttaaacacctgaaacatatttgttgttttaataatgaaatgacaggtggagtggggaccaaaaaaaccaacaactagggactttgatcttgtaaatttacctttctgtactgatacaggacaggcccacctaaaaagactgacatgtgtcccactgttgacaaaggttttaattctcaggccctctaataggtatgctcataacgaatagtgactttctacctcacttaggccatccccacatcttgcaagtgatgctggaaaacagctgttctgtaatatccttagagtcagaactgaactaagattctgactttccccaagggcaatcttctccacccttctcagtcagttgaacaagggaaaaacctctagatggaagggaagagcccctacaatcagaaacccattttctaaaaactaacattccacatgtcatcatcatttgtaggggcaatttaaaaaataatccttggaagtcttgtctctaaatcatctccattctcactgtaaattattcttacccttgtcataccacacctacatgaggcatcacaacagccacctaacttggttctgctgcatcctctccttgctactcaatgcagaggaccagaagctggttagacatgcagagtctcaggccccaccccagacttattcagtcaaaaactgcacttgaaaaagaccctcagtgattcatgagcacattaaattggagaagaactattcccagccatccacactatcagccaaaccactcccttttttagtaaatcagtactgctcagcctggctaagaaggcccaaaagagacacttcgaagtcctgagcattactttccaatcctgctactatgcactctccatggaaagcagactgccttctggagaacacaggtagaacacctggcacagtgctaagtggcatctagtatccactcaataaatgtgcatttcctttccttatgtctattcaccacttactatctctttcagtccatccctttcctataaggatatctcttcctcctaggatctattttgaattctctaatgaagtggttacaagcctaggttctaacgtcaaagttttagctctaaaacttatttactctgtgaattaggaaaactaattttacttcgccagacctctttccacttttgtaaactgaagatgtttgtaacagtgcctttctcttggggttgctgtgaaagcactcaattggtattagctatcactagtattcaagcacagataaaaatctcttcactgactgctttagttgctttagtcttccatactttccctctcatttaaagggctacagcactgacaggtaaagtacacaacttagcacccaattataacactcctataggggcctttaagttttttgtattgttgattctgtcatgtaacctgaatcttaataataaaaaggggttaggattagtgttgtttgtatagattatgaaagtaattcacggccgttcgagaaatatagaaagtagagaaaaatattaaaaagacactgaaaatcagccataatctcaccactcagagacaactgttaacacttagaatatttccttccaaagagtagatcttatatgtttcaggagggcaaggagcaagtcttaacctcgttggaattttccatgacttccctccacccaataatgccccttcatacctaccccagcacctaatctagcacaatgctgaccacttaccagctgacaaatacatacctcttccttagatgaatgatgtattaagtggcatgcccctgtacttatatatttctatctatagaaaaagggatgttgtcagagtcagtgacataatttggttggttcttcactcagttctaactgctgtaagtgtgctcatatctgtattctgtgtgactgctgtttgtgtttggtggccaaagcgcatttctggtggtttcacgttttccttttcaacgtactcagatttcacatacctacaggaatggtcatcccatgaattttatcagcccagcctgcgtaatatcgaaaggttttgatgacgccctgcaaatccacataaaaagcttgcaggaatggtttgccaccatttagggattccatggtctgttggaagagaaatggagagatactaagtccccagaactttccagcgatacactaatttctagagcagaagaaaaaaggaagagagagaatacaaatgcatatggagttgcatacctggtcaactatgaattctcaaataaaaagatttctagtactgccagtttggtctagttcctagtaaaaaccacaatgagtatatatgtgcatattcctgtgcttccagtaaccactatccaaatacgttaacacaatatttctttaactaatgataaagaaatgttctgcttgtcaaaacagcttccgttatattaatgatcagagctcactggggattttttggcatctacaccagtaatctgaatccataaagaggagcagaaacatgggctctttatgcaactgatgagaatagaaagtgttctccacagctgccaagacccctgctgagaaatggaatatccatggtgcacagcaagtttatttattaccaccaaataaacaagatctcctctagggaagcccagatgttaacaacttaaaggctggttttttgtaaacatttacattaacaaccattacctattaagagtgaaatatctgctccatttaataaaaatagcaatattgaactgctttacattataaacattgttattttaacgacatgttcctgaactggctaagtccgtaacaaaaacaatgaacacgctgaaatgagaagagtattttgacttgagaaatattaaaggtgttacaagttcgacaaatgaaattaacaaacatgtttgtaattttctttttttcctacaagtgtattttataagacatactggtgtgaaaattatttgatctctgacaaagctaaaattaaaatattctccaatcaatgagatgaaaatactatgacttccagtgtaatttatctacttagtatgtgtataaaatgaagcttatttaaaaatatcatgttacttatcactgtatattggctcacccttaaaaaagggaatcaaactatttcctagtactttttagaacatgtatatgtttacaagataggcattacattctctatacagctagcatagcaccaaaatctgcacagcttagagtgaatagtgtcaataaccagaatttgggctgcctaaatggtccctgtgagctgccgacaccagtcaaatccactgacaattgccagctctaggactattttcaattgtgtttactttggatgcaggattagcttcagttttccagtcaggagctcccctttcttccacaggctacctcttactaaaactcacttttctcatagcttgagagtgtttaaaacaggaatctcatttaggtgtggtaggaaaagagacctgatcagtgagacacagagaagaaaaagaaaggcatttgagttttattatatgaaaatataactggagaaattaattaatcatcttctagcacagtgttaatccaatgctatagatatcatatatctttagctcaattaaacagtcatttattgacaacctatgtgccctcatttgccatttatgtgctaagaaccatgctaggattaccaaaaaaaggtaaaatacaagtttaattctcaagaaaatgataatccagtgaaaagacaagtaatgtgtcccaaaaaacttggttttgcatgatattggtatgttagccagaaaaatggtgatgagactcaaataagcttgagaagcatttagtaggcttttcctgagcctttaatatgcccagtgtcttgtgaatctgcaaggaggaatttcttcaccatgaaacacctttttcacagtatgaataaacacctcattggaagagtattccctagagtgccagattagaaaatatttttatatacacataaatgttatatatagctagaatcccaaaccatttccataaaggaatcattttgttcccatactatgaacagattcctgagggggatggtagaagggaagaactatggtaggagggacactgagaaagggaaaaaatgattccttccccagaagcaagcccaatagtgacctattttcccaagtaggggaaaggatatagtactcatggcttgaatgccctgactgaacaaggaaaccctaaatattcattgataccaggtggagatcccaaatgtatagtgcatacattcctaaatgctttcagtttccaaaaagtttatattctctaagaaattgacttttattttaaaaacagcaacaacaacaaaacccattagggcaggagaagttcgttatgtgaggaaaatcattgttttagtgaaaggaagttgctatctcctgctgtctctcctttctactggctcacagaatgacagggcaaacggagcagaagtgtatgagaggtccgtaccatcccctctggttctgaaggattccttttactcaagagaggttaactctggggaggtaaaaacttgttctatttcattctcataagaatcatttgatactcgttttctgcaagcagcatggtgactctcttgttgcttgactgtttttaatttgtcatggggagggggagttttagaaaagaaggtacttaccagtcatggcaagctccagttttctcttcaaaattcagtgagaaaagatattcagctgatcctccatttctccttctccatctgatccccaaatccaaacatgtctcatttttcatatgtattacctattcctttgctttttccccaggtctgcttcaaagtatccttttaggagctcaagaccagcctgaccaacatagtgaaaccccgtctctactaaaaatacaaaaattagccaggtgtggtggcacgtgcacgtaatcccagctactcaggaggctgaggcaggagaatcgcttgtacctgggaggcagaggttgcagtgagctgaaatcgtgccactgcgctccagcctgggcgacagagctagactccgtctcaaaaaataaaataaataaaaataaaataaaatacagccgaagaatgtaaatttcagcagaatggcaaatgtgggttaaagacttaatgttttcttaggttacttactgcaagaactgccctgtcccgttccaccaagtctgcaagcttatccaacagacgtcccctttctgaagcatccatccttctccacactgaaccaagagagaaagccaggcgggctgcctgcactgctttgtctatatctgcctgttagagaggaagaggcacaactgaagaaaaacactccaaataaaggaagaaccatccactgtcatgaaaaaagtgaagcatgagcatgtagtggtg
